(12) United States Patent
Klaenhammer et al.

(10) Patent No.: US 7,348,420 B2
(45) Date of Patent: Mar. 25, 2008

(54) LACTOBACILLUS ACIDOPHILUS NUCLEIC ACID SEQUENCES ENCODING CELL SURFACE PROTEIN HOMOLOGUES AND USES THEREFORE

(75) Inventors: Todd R. Klaenhammer, Raleigh, NC (US); Eric Altermann, Apex, NC (US); B. Logan Buck, Banner Elk, NC (US); W. Michael Russell, Newburgh, IN (US)

(73) Assignee: North Carolina State University, Raleigh, NC (US)

(*) Notice: Subject to any disclaimer, the term of this patent is extended or adjusted under 35 U.S.C. 154(b) by 477 days.

(21) Appl. No.: 10/831,070

(22) Filed: Apr. 23, 2004

(65) Prior Publication Data

US 2005/0112612 A1 May 26, 2005

Related U.S. Application Data

(60) Provisional application No. 60/465,621, filed on Apr. 25, 2003.

(51) Int. Cl.
*C07H 21/04* (2006.01)
*C12N 1/20* (2006.01)
*C12N 15/00* (2006.01)
*C12P 1/20* (2006.01)

(52) U.S. Cl. .................. 536/23.1; 435/69.1; 435/252.3; 435/320.1

(58) Field of Classification Search ............... 536/23.1; 435/320.1, 69.1, 252.3
See application file for complete search history.

(56) References Cited

U.S. PATENT DOCUMENTS

| | | | |
|---|---|---|---|
| 5,695,966 A * | 12/1997 | Inventi et al. ............... 435/78 |
| 5,837,509 A | 11/1998 | Israelsen et al. | |
| 6,451,584 B2 | 9/2002 | Tomita et al. | |
| 6,476,209 B1 | 11/2002 | Glenn et al. | |
| 6,544,772 B1 | 4/2003 | Glenn et al. | |
| 6,635,460 B1 | 10/2003 | Van Hijum et al. | |
| 2002/0159976 A1 | 10/2002 | Glenn et al. | |
| 2003/0138822 A1 | 7/2003 | Glenn et al. | |
| 2004/0009490 A1 | 1/2004 | Glenn et al. | |
| 2004/0208863 A1 | 10/2004 | Versalovic et al. | |
| 2005/0003510 A1 | 1/2005 | Chang et al. | |
| 2005/0123941 A1 | 6/2005 | Klaenhammer et al. | |

FOREIGN PATENT DOCUMENTS

| | | |
|---|---|---|
| EP | 0 888 118 B1 | 1/1999 |
| WO | WO 02/12506 A1 | 2/2002 |
| WO | WO 02/074798 A2 | 9/2002 |
| WO | WO 03/084989 A2 | 10/2003 |
| WO | WO 2004/020467 A2 | 3/2004 |
| WO | WO 2004/031389 A1 | 4/2004 |
| WO | WO 2004/069178 A2 | 8/2004 |
| WO | WO 2004/096992 A2 | 11/2004 |
| WO | WO 2005/001057 A2 | 1/2005 |
| WO | WO 2005/012491 A2 | 2/2005 |

OTHER PUBLICATIONS

Christensen et al. "Peptidases and Amino Acid Catabolism in Lactic Acid Bacteria" *Antonie can Leeuwenhoek* 76: 217-246 (1999).
Holzapfel et al. "Taxonomy and Important Features of Probiotic Microorganisms in Food and Nutrition" *American Journal of Clinical Nutrition* 73 (suppl): 365S-373S (2001).
Hugenholtz et al. "Metabolic Engineering of Lactic Acid Bacteria: Overview of the Approaches and Results of Pathway Rerouting Involved in Food Fermentations" *Current Opinion in Biotechnology* 10: 492-497 (1999).
Kok et al. "The Proteolytic System of Lactic Acid Bacteria" *Genetics and Biotechnology of Lactic Acid Bacteria* pp. 169-210, M. Gasson and W.M. DeVos, Eds., Blackie and Professional, London, England (1994).
Kuipers et al. "Current Strategies for Improving Food Bacteria" *Res Microbiol* 151: 815-822 (2000).
Law et al. "Proteolytic Enzymes of Lactic Acid Bacteria" *Int Dairy Journal* 7: 1-11 (1997).
Altermann et al. (2005) Supporting Materials and Methods for "Complete genome sequence of the probiotic lactic acid bacterium *Lactobacillus acidophilus* NCFM" *Proc. Natl. Acad. Sci. U.S.A.* Early Edition 10.1073/pnas.0409188102, online publication date Jan. 25, 2005 accessible online <http://www.lib.ncsu.edu:2112/cgi/content/full/0409188102/DC1/1>.
Abee et al. (1994) "Kinetic studies of the action of lactacin F, a bacteriocin produced by *Lactobacillus johnsonii* that forms poration complexes in the cytoplasmic membrane" *Appl. Environ. Microbiol.* 60:1006-10013.
Allison and Klaenhammer (1996) "Functional analysis of the gene encoding immunity to lactacin F, *lafI*, and its use as a *Lactobacillus*-specific, food-grade genetic marker" *Appl. Environ. Microbiol.* 62:4450-4460.
Allison and Klaenhammer (1999) "Genetics of bacteriocins produced by lactic acid bacteria and their use in novel industrial applications" in *Manual of Industrial Microbiology and Biotechnology*. DeMain and Davies (eds.), ASM Press, Washington, D.C., pp. 789-808.
Allison et al. (1994) "Expansion of bacteriocin activity and host range upon complementation of two peptides encoded with the lactacin F operon" *J. Bacteriol.* 176:2235-2241.

(Continued)

*Primary Examiner*—Mark Navarro
(74) *Attorney, Agent, or Firm*—Alston & Bird LLP

(57) ABSTRACT

Cell wall, cell surface and secreted protein nucleic acid molecules and polypeptides and fragments and variants thereof are disclosed in the current invention. In addition, cell wall, cell surface and secreted fusion proteins, antigenic peptides, and anti-cell wall, cell surface and secreted antibodies are encompassed. The invention also provides recombinant expression vectors containing a nucleic acid molecule of the invention and host cells into which the expression vectors have been introduced. Methods for producing the polypeptides of the invention and methods for their use are further disclosed.

25 Claims, 1 Drawing Sheet

OTHER PUBLICATIONS

Altermann et al. (2004) "Identification and phenotypic characterization of the cell-division protein CdpA" *Gene* 342:189-197.

Altermann et al. (2005) "Complete genome sequence of the probiotic lactic acid bacterium *Lactobacillus acidophilus* NCFM" *Proc. Natl. Acad. Sci. U.S.A.* Early Edition 10.1073/pnas. 0409188102, online publication date Jan. 25, 2005.

Azcarate-Peril et al. (2004) "Identification and inactivation of genetic loci involved with *Lactobacillus acidophilus* acid tolerance" *Appl. Environ. Microbiol.* 70:5315-5322.

Barefoot and Klaenhammer (1983) "Detection and activity of lactacin B, a bacteriocin produced by *Lactobacillus acidophilus*" *Appl. Environ. Microbiol.* 45:1808-1815.

Barefoot and Klaenhammer (1984) "Purification and characterization of the *Lactobacillus acidophilus* bacteriocin lactacin B" *Antimicrob. Agents Chemother.* 26:328-334.

Barefoot et al. (1994) "Identification and purification of a protein that induces production of the *Lactobacillus acidophilus* bacteriocin lactacin B" *Appl. Environ. Microbiol.* 60:3522-3528.

Barrangou et al. (2003) "Functional and comparative genomic analyses of an operon involved in fructooligosaccharide utilization by *Lactobacillus acidophilus*" *Proc. Natl. Acad. Sci. U.S.A.* 100:8957-8962.

Boels et al. (2001) "Functional analysis of the *Lactococcus lactis* ga/U and ga/E genes and their impact on sugar nucleotide and exopolysaccharide biosynthesis" *Appl. Environ. Microbiol.* 67:3033-3040.

Bruno-Barcena et al. (2004) "Expression of heterologous manganese superoxide dismutase gene in intestinal lactobacilli provides protection against hydrogen peroxide toxicity" *Appl. Environ. Microbiol.* 70:4702-4710.

Coconnier et al. (1992) "Protein-mediated adhesion of *Lactobacillus acidophilus* BG2FO4 on human enterocyte and mucus-secreting cell lines in culture" *Appl. Environ. Microbiol.* 58:2034-2039.

Contreras et al. (1997) "Isolation, purification and amino acid sequence of lactobin A, one of the two bacteriocins produced by *Lactobacillus amylovorus* LMG P-13139" *Appl. Environ. Microbiol.* 63:13-20.

De Vuyst and Degeest (1998) "Heteropolysaccharides from lactic acid bacteria" *FEMS Microbiol. Rev.* 23:153-177.

Dodd and Gasson (1994) "Bacteriocins of lactic acid bacteria" in *Genetics and Biotechnology of Lactic Acid Bacteria*. Gasson and de Vos (eds.), Blackie Academic and Professional, London, pp. 211-251.

Fremaux et al. (1993) "Molecular analysis of the lactacin F operon" *Appl. Environ. Microbiol.* 59:3906-3915.

Girgis et al. (2002) "Stress adaptations of lactic acid bacteria" in *Microbial adaptation to stress and safety of new-generation foods*. Yousef and Juneja (eds.) CRC Press, NY, pp. 159-212.

Greene and Klaenhammer (1994) "Factors involved in adherence of lactobacilli to human Caco-2 cells" *Appl. Environ. Microbiol.* 60:4487-4494.

Joerger and Klaenhammer (1986) "Characterization and purification of helveticin J and evidence for a chromosomally determined bacteriocin produced by *Lactobacillus helveticus*" *J. Bacteriol.* 167:439-446.

Joerger et al. (1990) "Cloning, expression, and nucleotide sequence of the *Lactobacillus helveticus* 481 gene encoding the bactericin helveticin J" *J. Bacteriol.* 172:6339-6347.

Jolly et al. (2002) "Exploiting exopolysaccharides from lactic acid bacteria" *Antonie van Leeuwenhoek* 82:367-374.

Klaenhammer (1988) "Bacteriocins of lactic acid bacteria" *Biochimie* 70:337-349.

Klaenhammer (1993) "Genetic of bacteriocins produced by lactic acid bacteria" *FEMS Microbiol. Rev.* 12:39-85.

Klaenhammer (2000) "Probiotic bacteria: today and tomorrow" *J. Nutr.* 130(2S Suppl.):415S-416S.

Klaenhammer and Kullen (1999) "Selection and design of probiotics" *Int. J. Food Microbiol.* 50:45-57.

Klaenhammer and Sutherland (1980) "Detection of plasmid deoxyribonucleic acid in an isolate of *Lactobacillus acidophilus*" *Appl. Environ. Microbiol.* 39:671-674.

Klaenhammer et al. (2002) "Discovering lactic acid bacteria by genomics" *Antonie van Leeuenhoek* 82:29-58.

Kleeman and Klaenhammer (1982) "Adherence of *Lactobacillus* species to human fetal intestinal cells" *J. Dairy Sci.* 65:2063-2069.

Kleerebezem et al. (1999) "Exopolysaccharides produced by *Lactococcus lactis*: from genetic engineering to improved rheological properties?" *Antonie van Leeuwenhoek* 76:357-365.

Kleerebezem et al. (2003) "Complete genome sequence of *Lactobacillus plantarum* WCFSI" *Proc. Natl. Acad. Sci. U.S.A.* 100:1990-1995.

Konigs et al. (1997) "The role of transport processes in survival of lactic acid bacteria" *Antonie van Leeuwenhoek* 71:117-128.

Konigs et al. (2000) "Lactic acid bacteria: the bugs of a new millennium" *Curr. Opin. Microbiol.* 3:276-282.

Kullen and Klaenhammer (1999) Identification of the pH-inducible, proton-translocating $F_1F_0$-ATPase (atpBEFHAGDC) operon of *Lactobacillus acidophilus* by differential display: gene structure, cloning and characterization" *Mol. Microbiol.* 33:1152-1161.

Kullen and Klaenhammer (2000) "Genetic modification of intestinal lactobacilli and bifidobacteria" *Curr. Issues Mol. Biol.* 2:41-50.

Kullen et al. (2000) "Use of the DNA sequence of variable regions of the 16S rRNA gene for rapid and accurate identification of bacteria in the *Lactobacillus acidophilus* complex" *J. Appl. Microbiol.* 89:511-516.

Luchansky et al. (1988) "Application of electroporation for transfer of plasmid DNA to *Lactobacillus, Lactococcus, Leuconostoc, Listeria, Pediococcus, Bacillus, Staphylococcus, Enterococcus* and *Propionobacterium*" *Mol. Microbiol.* 2:637-646.

Luchansky et al. (1989) "Genetic transfer systems for delivery of plasmid deoxyribonucleic acid to *Lactobacillus acidophilus* ADH: conjugation, electroporation, and transduction" *J. Dairy Sci.* 72:1408-1417.

Luchansky et al. (1991) "Molecular cloning and deoxyribonucleic acid polymorphisms in *Lactobacillus acidophilus* and *Lactobacillus gasseri*" *J. Dairy Sci.* 74:3293-3302.

Majhenic et al. (2004) "DNA analysis of the genes encoding acidocin LF221 A and acidocin LF221 B, two bacteriocins produced by *Lactobacillus gasseri* LF221" *Appl. Microbiol. Biotechnol.* 63:705-714.

Mohamadzadeh et al. (2005) "Lactobacilli activate human dendritic cells that skew T cells toward T helper I polarization" *Proc. Nat. Acad. Sci. USA* 102:2880-2885.

Muriana and Klaenhammer (1991) "Cloning, phenotypic expression, and DNA sequence of the gene for lactacin F, an antimicrobial peptide produced by *Lactobacillus spp.*" *J. Bacteriol.* 173:1779-1788.

Muriana and Klaenhammer (1991) "Purification and partial characterization of lactacin F, a bacteriocin produced by *Lactobacillus acidophilus* 11088" *Appl. Environ. Microbiol.* 57:114-121.

Pao et al. (1998) "Major Facilitator Superfamily" *Microbiol. Mol. Biol. Rev.* 62:1-34.

Poolman (2002) "Transporters and their roles in LAB cell physiology" *Antonie van Leeuwenhoek* 82:147-164.

Pridmore et al. (2004) "The genome sequence of the probiotic intestinal bacterium *Lactobacillus johnsonii* NCC 533" *Proc. Natl. Acad. Sci. U.S.A.* 101:2512-2517.

Putman et al. (2000) "Molecular properties of bacterial multidrug transporters" *Microbiol. Mol. Biol. Rev.* 64:672-693.

Rastall et al. (2005). Modulation of the microbial ecology of the human colon by probiotics, prebiotics and synbiotics to enhance human health: An overview of enabling science and potential applications. *FEMS Microbiol. Ecol.* 52:145-152.

Roy et al. (1993) "Cloning and expression of the manganese superoxide dismutase gene of *Escherichia coli* in *Lactococcus lactis* and *Lactobacillus gasseri*" *Mol. Gen. Genet.* 239:33-40.

Russell and Klaenhammer (2001) "Efficient system for directed integration into the *Lactobacillus acidophilus* and *Lactobacillus gasseri* chromosomes via homologous recombination" *Appl. Environ. Microbiol.* 67:4361-4364.

Russell and Klaenhammer (2001) "Identification and cloning of gusA, encoding a new β-glucuronidase from *Lactobacillus gasseri* ADH" *Appl. Environ. Microbiol.* 67:1253-1261.

Sablon et al. (2000) "Antimicrobiol peptides of lactic acid bacteria: mode of action, genetics and biosynthesis" in *Advances in Biochemical Engineering/Biotechnology*. vol. 68. Schleper (ed.), Springer-Verlag, Berlin, pp. 21-60.

Sanders and Klaenhammer (2001) "Invited review: the scientific basis of *Lactobacillus acidophilus* NCFM functionality as a probiotic" *J. Dairy Sci.* 84:319-331.

Sanders et al. (1996) "Performance of commercial cultures in fluid milk applications" *J. Dairy Sci.* 79:943-955.

Steidler et al. (1998) "Functional display of a heterologous protein on the surface of *Lactococcus lactis* by means of the cell wall anchor of *Staphylococcus aureus* protein A" *Appl. Environ. Microbiol.* 64:342-345.

Sturino and Klaenhammer (2004) "Bacteriophage defense systems for lactic acid bacteria" *Adv. Appl. Microbiol.* 56:331-378.

Ventura et al. (2003) "Analysis, characterization, and loci of *tuf* genes in *Lactobacillus* and *Bifidobacterium* species and their direct application for species identification" *Appl. Environ. Microbiol.* 69:6908-6922.

Vos et al. (1991) "Engineering of the *Lcactococcus lactis* Serine Proteinase by Construction of Hybrid Enzymes" *Protein Engineering* 4(4):479-484.

Walker et al. (1999) "The groESL chaperone operon of *Lactobacillus johnsonii*" *Appl. Environ. Microbiol.* 65:3033-3041.

Yother et al. (2002) Genetics of streptococci, lactococci, and enterococci: review of the sixth international conference *J. Bacteriol.* 184:6085-6092.

GenBank Accession No. AAA19050, filed Jun. 1, 1994; Source: *Lactobacillus helveticus*.

GenBank Accession No. AAA25250, filed Jan. 13, 1994; Aminopeptidase C.; Source: *Lactobacillus helveticus*.

GenBank Accession No. AAB52540, filed Apr. 18, 1997; Endopeptidase; Source: *Lactobacillus helveticus*.

GenBank Accession No. AAB66326, filed Aug. 7, 1997; GroEL; Source: *Lactobacillus zeae*.

GenBank Accession No. AAC29003; filed Aug. 7, 1998; cochaperonin GroES; Source: *Lactobacillus helveticus*.

GenBank Accession No. AAC99363, filed Sep. 10, 1999; D-lactate dehydrogenase; Source: *Lactobacillus johnsonii*.

GenBank Accession No. AAF22492, filed Aug. 30, 2001; F1F0-ATPase subunit a; Source: *Lactobacillus acidophilus*.

GenBank Accession No. AAF22493, filed Aug. 30, 2001; F1F0-ATPase subunit c; Source: *Lactobacillus acidophilus*.

GenBank Accession No. AAF22494, filed Aug. 30, 2001; F1F0-ATPase subunit b; Source: *Lactobacillus acidophilus*.

GenBank Accession No. AAF22495, filed Aug. 30, 2001; F1F0-ATPase subunit delta; Source: *Lactobacillus acidophilus*.

GenBank Accession No. AAF22496, filed Aug. 30, 2001; F1F0-ATPase subunit alpha; Source: *Lactobacillus acidophilus*.

GenBank Accession No. AAF22497, filed Aug. 30, 2001; F1F0-ATPase subunit gamma; Source: *Lactobacillus acidophilus*.

GenBank Accession No. AAF22498, filed Aug. 30, 2001; F1F0-ATPase subunit beta; Source: *Lactobacillus acidophilus*.

GenBank Accession No. AAF22499, filed Aug. 30, 2001; F1F0-ATPase subunit epsilon; Source: *Lactobacillus acidophilus*.

GenBank Accession No. AAF75593, filed Jun. 13, 2000; GroEL; Source: *Lactobacillus johnsonii*.

GenBank Accession No. AAK97217, filed Sep. 2, 2001; cochaperonin GroES; Source: *Lactobacillus acidophilus*.

GenBank Accession No. AAK97218, filed Sep. 2, 2001; chaperonin GroEL; Source: *Lactobacillus acidophilus*.

GenBank Accession No. AAK97220, filed Sep. 2, 2001; cochaperonin GrpE; Source: *Lactobacillus acidophilus*.

GenBank Accession No. AAK97221, filed Sep. 2, 2001; heat shock protein Dnak; Source: *Lactobacillus acidophilus*.

GenBank Accession No. AAQ72431, filed Jun. 3, 2005; Endopeptidase E2; Source: *Lactobacillus helveticus*.

GenBank Accession No. AAR25444, filed Dec. 3, 2003; Tuf; *Lactobacillus johnsonii*.

GenBank Accession No. AAT09141, filed Sep. 7, 2004; amino acid permease La995; Source: *Lactobacillus acidophilus*.

GenBank Accession No. AF010281, filed Aug. 9, 1997, Lactobacillus zeae GroES; Source: *Lactobacillus zeae*.

GenBank Accession No. AF031929, filed Aug. 8, 1998; Lactobacillus helveticus cochaperonin GroES and chaperonin GroEL genes, complete cds and DNA mismatch repair enzyme (hexA) gene, partial cds; Source: *Lactobacillus helveticus*.

GenBank Accession No. AF071558, filed Sep. 10, 1999; Lactobacillus johnsonii D-lactate dehydrogenase (ldhD) gene, complete cds; Source: *Lactobacillus johnsonnii*.

GenBank Accession No. AF098522, filed Aug. 30, 2001; Lactobacillus acidophilus uracil phosphoribosyltransferase; Source: *Lactobacillus acidophilus*.

GenBank Accession No. AF214488, filed Jun. 13, 2000; Lactobacillus johnsonii groESL operon, complete sequence and unknown gene; Source: *Lactobacillus johnsonii*.

GenBank Accession No. AF300645, filed Sep. 2, 2001; Lactobacillus acidophilus groESL operon, complete sequence; Source: *Lactobacillus acidophilus*.

GenBank Accession No. AF300646, filed Sep. 2, 2001; Lactobacillus acidophilus repressor protein HrcA (hrcA) gene, partial cds; cochaperonin GrpE (grpE) and heat shock protein DnaK (dnaK) genes, complete cds, and DnaJ (dnaJ) gene, partical cds; Source: *Lactobacilus acidophilus*.

GenBank Accession No. B59088, filed Jun. 20, 1998; Prolyl Aminopeptidase; Source: *Lactobacillus helveticus*.

GenBank Accession No. CAA42781, filed Nov. 5, 1992; D-lactate dehydrogenase; Source: *Lactobacillus delbrueckii*.

GenBank Accession No. CAA59019, filed Apr. 18, 2005; heat shock induced protein Htpl; Source: *Lactobacillus leichmannii*.

GenBank Accession No. CAA61561, filed Jan. 22, 1996; SB-protein; *Lactobacillus acidophilus*.

GenBank Accession No. CAA86210, filed Oct. 17, 1996; Dipeptidase; Source: *Lactobacillus helveticus*.

GenBank Accession No. CAB72938, filed Apr. 15, 2005; Tripeptidase Enzyme; Source: *Lactobacillus helveticus*.

GenBank Accession No. NP_964658, filed Jan. 26, 2007; probable xylulose-5-phosphate/fructose-6-phosphate phosphoketolase; Source: *Lactobacillus johnsonii* NCC 533.

GenBank Accession No. NP_964694, filed Jan. 26, 2007; RecA protein; Source: *Lactobacillus johnsonii* NCC 533.

GenBank Accession No. NP_964728, filed Jan. 26, 2007; phosphoglycerate kinase; Source: *Lactobacillus johnsonii* NCC 533.

GenBank Accession No. NP_964948, filed Jan. 26, 2007; DNA-binding protein HU; Source: *Lactobacillus johnsonii* NCC 533.

GenBank Accession No. NP_965314, filed Jan. 26, 2007; 50S ribosomal protein L19; Source: *Lactobacillus johnsonii* NCC 533.

GenBank Accession No. NP_965472, filed Jan. 26, 2007; thioredoxin; Source: *Lactobacillus johnsonii* NCC 533.

GenBank Accession No. NP_965500, filed Jan. 26, 2007; hypothetical protein LJ1693; Source: *Lactobacillus johnsonii* NC 533.

GenBank Accession No. NP_966600, filed Dec. 2, 2005; hypothetica protein LJ1693; Source: *Lactobacillus johnsonii* NC 533.

GenBank Accession No. O07684, filed Oct. 17, 2006; Beta-galactosidase large subunit; Source: *Lactobacillus acidophilus*.

GenBank Accession No. O07685, filed Nov. 28, 2006; Beta-galactosidase small subunit; Source: *Lactobacillus acidophilus*.

GenBank Accession No. O32755, filed Oct. 17, 2006; Glyceraldehyde-3-phosphate dehydrogenase; Source: *Lactobacillus delbrueckii* subsp. *Bulgaricus*.

GenBank Accession No. O32756, filed Apr. 18, 2006; Phosphoglycerate kinase; Source: *Lactobacillus delbrueckii* subsp. *Bulgaricus*.

GenBank Accession No. O32765, filed Nov. 28, 2006; L-lactate dehydrogenase; Source: *Lactobacillus helveticus*.

GenBank Accession No. O68324, filed Mar. 21, 2006; 60 kDa chaperonin; Source: *Lactobacillus helveticus*.

GenBank Accession No. O84913, filed Nov. 28, 2006; Xaa-Pro dipeptidase; Source: *Lactobacillus helveticus*.

GenBank Accession No. P26297, filed Jan. 23, 2007; D-lactate dehydrogenase; Source: *Lactobacillus delbrueckii* subsp. *Bulgaricus*.

GenBank Accession No. P30901, filed Jan. 23, 2007; D-lactate dehydrogenase; Source: *Lactobacillus helveticus*.

GenBank Accession No. P34038, filed Nov. 28, 2006; Pyruvate kinase; Source: *Lactobacillus delbrueckii subsp. Bulgaricus*.

GenBank Accession No. P35829, filed Jan. 9, 2007; S-layer protein precursor; Source: *Lactobacillus acidophilus*.

GenBank Accession No. P43451, filed Oct. 17, 2006, ATP synthase beta chain; Source: *Enterococcus hirae*.

GenBank Accession No. P94870, filed Feb. 7, 2006; Aminopeptidase E.; Source: *Lactobacillus helveticus*.

GenBank Accession No. Q00052, filed Mar. 21, 2006; Galactokinase; Source: *Lactobacillus helveticus*.

GenBank Accession No. Q10730, filed Feb. 7, 2006; Aminopeptidase N; Source: *Lactobacillus helveticus*.

GenBank Accession No. Q10744, filed Feb. 7, 2006; Aminopeptidase C.; Source: *Lactobacillus helveticus*.

GenBank Accession No. Q48558, filed Nov. 28, 2006; Dipeptidase A.; Source: *Lactobacillus helveticus*.

GenBank Accession No. Q9Z4H7, filed Oct. 17, 2006; Serine protease do-like htrA; Source: *Lactobacillus helveticus*.

GenBank Accession No. S47274, filed Feb. 1, 2002; Membrane Alanyl Aminopeptidase; Source: *Lactobacillus helveticus*.

GenBank Accession No. S47276, filed Jan. 6, 1995; Prolinase; Source: *Lactobacillus helveticus*.

GenBank Accession No. X60220, filed Nov. 5, 1992; L. delbrueckii subsp. Bulgaricus ldhA gene for D-lactate dehydrogenase; Source: *Lactobacillus delbrueckii*.

GenBank Accession No. X84261, filed Apr. 18, 2005; L.Leichmannii xerC, hs1U and hs1V; Source: *Lactobacillus leichmannii*.

GenBank Accession No. X89376, filed Jan. 22, 1996; L. acidophilus DNA for SB-protein gene; Source: *lactobacillus acidophilus*.

GenBank Accession No. ZP_00046537, filed May 25, 2006; COG0124: Histidyl-tRNA sythetase; Source: *Lactobacillus gasseri*.

GenBank Accession No. ZP_00046557, filed May 25, 2006; COG0148: Enolase; Source: *Lactobacillus gasseri*.

GenBank Accession No. ZP_00046583, filed May 25, 2006; COG0195: Transcription elongation factor; Source: *Lactobacillus gasseri*.

GenBank Accession No. ZP_00047305; filed May 25, 2006 COG4690; Dipeptidase; Source: *Lactobacillus gasseri*.

GenBank Accession No. ZP_00341831, filed May 25, 2006; COG0522: Ribosomal protein S4 and related proteins; Source: *Lactobacillus gasseri*.

GenBank Accession No. Q03234, filed Oct. 17, 2006; ATP synthesis beta chain; *Lactobacillus casei*.

\* cited by examiner

US 7,348,420 B2

LACTOBACILLUS ACIDOPHILUS NUCLEIC ACID SEQUENCES ENCODING CELL SURFACE PROTEIN HOMOLOGUES AND USES THEREFORE

CROSS REFERENCE TO RELATED APPLICATION

This application claims the benefit of U.S. Provisional Application Ser. No. 60/465,621, filed Apr. 25, 2003, the contents of which are herein incorporated by reference in their entirety.

FIELD OF THE INVENTION

This invention relates to polynucleotides isolated from lactic acid bacteria, namely *Lactobacillus acidophilus*, and polypeptides encoded by them as well as methods for using the polypeptides and microorganisms expressing them.

BACKGROUND OF THE INVENTION

*Lactobacillus acidophilus* is a Gram-positive, rod-shaped, non-spore forming, homofermentative bacterium that is a normal inhabitant of the gastrointestinal and genitourinary tracts. Since its original isolation by Moro (1900) from infant feces, the "acid loving" organism has been found in the intestinal tract of humans, breast-fed infants, and persons consuming high milk, lactose, or dextrin diets. Historically, *L. acidophilus* is the *Lactobacillus* species most often implicated as an intestinal probiotic capable of eliciting beneficial effects on the microflora of the gastrointestinal tract (Klaenhammer and Russell (2000) "Species of the *Lactobacillus acidophilus* complex," *Encyclopedia of Food Microbiology*, Volume 2, pp. 1151-1157. Robinson et al., eds. (Academic Press, San Diego, Calif.). *L. acidophilus* can ferment hexoses, including lactose and more complex oligosaccharides, to produce lactic acid and lower the pH of the environment where the organism is cultured. Acidified environments (e.g., food, vagina, and regions within the gastrointestinal tract) can interfere with the growth of undesirable bacteria, pathogens, and yeasts. The organism is well known for its acid tolerance, survival in cultured dairy products, and viability during passage through the stomach and gastrointestinal tract. *Lactobacilli* and other commensal bacteria, some of which are considered as probiotic bacteria that "favor life," have been studied extensively for their effects on human health, particularly in the prevention or treatment of enteric infections, diarrheal disease, prevention of cancer, and stimulation of the immune system.

The cell wall of Gram-positive bacteria consists of a peptidoglycan macromolecule, with attached accessory molecules such as teichoic acids, teichuronic acids, lipoteichoic acids, lipoglycans, polyphosphates, and carbohydrates (Hancock (1997) *Biochem. Soc. Trans.* 25:183-187; Salton (1994) The bacterial cell envelope—a historical perspective, p. 1-22. In J.-M. Ghuysen and R. Hakenbeck (ed.) Bacterial cell wall. Elsevier Science BV, Amsterdam, The Netherlands). Proteins associated with the cell surface of Gram-positive bacteria include hydrolases and proteases, polysaccharides, surface exclusion proteins and aggregation-promoting proteins (thought to be involved in mating), S-layer proteins (subunits of crystalline arrays covering the outer surface of many single-celled organisms), sortase (a transpeptidase responsible for cleaving surface proteins at the LPXTG-like (SEQ ID NO:308) motifs), proteins with LPXTG-like motifs, and MSCRAMMs (microbial surface components recognizing adhesive matrix molecules) such as fibronectin-binding proteins, fibrinogen-binding proteins, and mucus-binding proteins.

Cell wall, cell surface, and secreted proteins of Gram-positive bacteria serve many diverse functions, including adhering to other cells or compounds, providing structural stability, and responding to environmental stimuli. Surface proteins of bacteria are important for survival within a host, and for cell growth and division. Furthermore, surface proteins are often recognized by a host's immune system to initiate immuno-stimulation, -modulation, or -enhancement. The isolation and characterization of these proteins will aid in developing essential probiotic products with numerous applications, including those that benefit human or animal health, and those concerned with food production and safety.

BRIEF SUMMARY OF THE INVENTION

Compositions and methods for modifying *Lactobacillus* organisms are provided. Compositions of the invention include isolated nucleic acid molecules from *Lactobacillus acidophilus* encoding cell wall, cell surface, and secreted proteins. Specifically, the present invention provides for isolated nucleic acid molecules comprising the nucleotide sequences found in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305 and 307, and isolated nucleic acid molecules encoding the amino acid sequences found in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304 and 306. Also provided are isolated or recombinant polypeptides having an amino acid sequence encoded by a nucleic acid molecule described herein. Variant nucleic acid molecules and polypeptides sufficiently identical to the nucleotide and amino acid sequences set forth in the sequence listings are encompassed by the present invention. Additionally, fragments and sufficiently identical fragments of the nucleotide and amino acid sequences are encompassed. Nucleotide sequences that are complementary to a nucleotide sequence of the invention, or that hybridize to a sequence of the invention, are also encompassed.

Compositions further include vectors and host cells for recombinant expression of the nucleic acid molecules described herein, as well as transgenic microbial populations comprising the vectors. Also included in the invention are methods for making the vectors and host cells described herein, as well as methods for the recombinant production of the polypeptides of the invention, and methods for their use. Further included are methods and kits for detecting the presence of a nucleic acid or polypeptide sequence of the invention in a sample, and antibodies that bind to a polypeptide of the invention.

The cell wall, cell surface, and secreted polypeptides encoded by the inventive sequences, and the transgenic microbes expressing them, have health-related benefits. The microbes transformed with these polynucleotide sequences may be taken internally as a pharmaceutical or probiotic composition or alternatively, the microbes or their encoded polypeptides may be administered separately or added to products to provide health-related benefits. The nucleic acid molecules of the invention may also enhance the stability of microorganisms expressing them, and therefore may be useful in the production and processing of various foods.

DETAILED DESCRIPTION OF THE INVENTION

Figure 1:
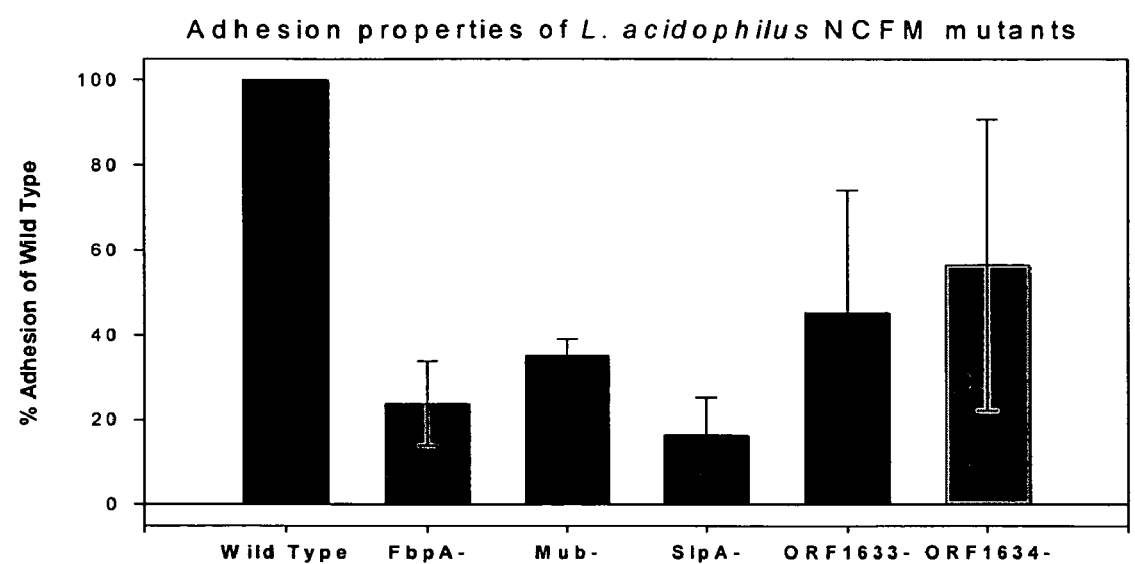
FIG. 1 shows the percent adhesion of wild-type *L. acidophilus* NCFM versus mutant bacteria lacking FpbA (SEQ ID NO:58), Mub (SEQ ID NO:18), SlpA (SEQ ID NO: 60), or streptococcal R28 proteins (SEQ ID NO:76 and SEQ ID NO:78, designated as ORF 1633 and ORF 1634, respectively).

The present invention relates to cell wall, cell surface and secreted molecules from *Lactobacillus acidophilus*. Nucleotide and amino acid sequences of the molecules are provided. The sequences find use in modifying organisms to have enhanced benefits.

By "cell wall, cell surface and secreted molecules" is intended novel cell wall, cell surface and secreted proteins from *L. acidophilus*. By "cell wall" is intended a protein found in association with the cell wall of a bacterial cell. By "cell surface" as it relates to a polypeptide or polynucleotide of the current invention is intended a protein found in association with the bacterial cell membrane. By "secreted" is intended a protein that is released from the cell it is expressed in. A protein of the invention may be classified as either a cell wall, a cell surface or a secreted protein, or may be included in more than one of these classifications. Furthermore, the term "cell wall, cell surface, or secreted" may be used to describe a single protein as well as more than one protein. See Table I for specific cell wall, cell surface and secreted protein molecules of the present invention.

These novel cell wall, cell surface and secreted proteins include cell components selected from the group consisting of peptidoglycans; teichoic acids; lipoteichoic acids; polysaccharides, including homopolysaccharides and heteropolysaccharides; adhesion proteins; secreted proteins; surface (s)-layer proteins; collagen-binding proteins and other cell surface proteins, and may include steroid binding proteins; lemA-like proteins; aggregation-promoting proteins; surface-exclusion proteins; myosin cross-reactive proteins; mucus binding precursors and proteins; fibronectin-binding proteins; sortases; biofilm-associated surface proteins; fibrinogen-binding proteins; tropomyosin-like proteins; FmtB-like surface proteins; psaA-like adhesins; lysM-like proteins; autolysins; cell shape-determining proteins; and rod shape-determining proteins. The full-length gene sequences are referred to as "cell wall, cell surface and secreted molecule sequences," indicating that they have similarity to cell wall, cell surface and secreted genes. The invention further provides fragments and variants of these cell wall, cell surface and secreted sequences, which can also be used to practice the methods of the present invention.

As used herein, the terms "gene" and "recombinant gene" refer to nucleic acid molecules comprising an open reading frame, particularly those encoding a cell wall, cell surface or secreted protein. Isolated nucleic acid molecules of the present invention comprise nucleic acid sequences encoding cell wall, cell surface and secreted proteins, nucleic acid sequences encoding the amino acid sequences set forth in SEQ ID NOS:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304 and 306 (hereinafter designated "even SEQ ID NOS:1-307"), the nucleic acid sequences set forth in SEQ ID NOS:1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305 and 307 (hereinafter designated "odd SEQ ID NOS:1-307"), and variants and fragments thereof. The present invention also encompasses antisense nucleic acid molecules, as described below.

In addition, isolated polypeptides and proteins associated with the cell wall, cell surface or that are secreted, and variants and fragments thereof, are encompassed. For purposes of the present invention, the terms "protein" and "polypeptide" are used interchangeably.

The compositions and methods of the present invention can be used to modulate the function of the cell wall, cell surface and secreted molecules of *L. acidophilus*. By "modulate," "alter," or "modify" is intended the up- or down-regulation of a target biological activity. Proteins of the invention are useful in modifying the biological activities of lactic acid bacteria, and also in modifying the nutritional or health-promoting characteristics of foods fermented by lactic acid bacteria. Nucleotide molecules of the invention are useful in modulating cell wall, cell surface and secreted protein expression by lactic acid bacteria. Up- or down-regulation of expression from a polynucleotide of the present invention is encompassed. Up-regulation may be accomplished by providing multiple gene copies, modulating expression by modifying regulatory elements, promoting transcriptional or translational mechanisms, or other means. Down-regulation may be accomplished by using known antisense and gene silencing techniques. Thus, proteins of the invention are useful in modulating the immune system, expression of host proteins, therapeutic benefits, stability, and other activities of lactic acid bacteria. By "lactic acid bacteria" is intended bacteria from a genus selected from the following: *Aerococcus, Carnobacterium, Enterococcus,*

*Lactococcus, Lactobacillus, Leuconostoc, Oenococcus, Pediococcus, Streptococcus, Melissococcus, Alloiococcus, Dolosigranulum, Lactosphaera, Tetragenococcus, Vagococcus,* and *Weissella* (Holzapfel et al. (2001) *Am. J. Clin. Nutr.* 73:365S-373S; Bergey's *Manual of Systematic Bacteriology*, Vol. 2 (Williams and Wilkins, Baltimore (1986) pp. 1075-1079).

The polypeptides of the present invention or microbes expressing them are useful as nutritional additives or supplements, and as additives in dairy and fermentation processing. The polynucleotide sequences, encoded polypeptides, and microorganisms expressing them are useful in the manufacture of milk-derived products, such as cheeses, yogurt, fermented milk products, sour milks, and buttermilk. Microorganisms that express polypeptides of the invention may be probiotic organisms. By "probiotic" is intended a live microorganism that survives passage through the gastrointestinal tract and has a beneficial effect on the host. By "host" is intended an organism that comes into contact with a polypeptide disclosed in the present invention or a microorganism expressing such a protein. Host may refer to humans and other animals as well as bacteria.

The polynucleotides and polypeptides of the present invention are useful in modifying the health-related benefits of milk-derived products. These uses include, but are not limited to modulating the immune system of a host; altering the expression of a host protein or compound; treating a gastrointestinal disorder; preventing or reducing the occurrence of an infection; binding, inactivating, removing, sequestering, degrading, digesting, cleaving or modifying detrimental compounds in a subject; enabling a microorganism to possess modified adherence properties; reducing the occurrence of dental caries in a subject; increasing feed conversion in production animals; enabling microorganisms or polypeptides to antagonize other microorganisms; protecting food from contamination; treating a wound; modulating the antibiotic sensitivity of a microorganism; enabling a microorganism to form a biofilm, or interfering with such an ability; treating or preventing cancer; treating heart disease; and lowering cholesterol. The uses also include modifying the texture of a food product produced by a lactic acid bacteria.

The polynucleotides and polypeptides of the present invention are also useful in enhancing the stability of a microorganism during industrial fermentation processes including storage, where exposure to various stresses can lead to reduced microbial viability, impaired metabolic activity and sub-optimal fermentation conditions. Stresses are also present in the gastrointestinal tract. Possible stresses include oxidative stress, pH, osmotic stress, dehydration, carbon starvation, phosphate starvation, nitrogen starvation, amino acid starvation, mechanical stress, altered pressure, heat or cold shock and mutagenic stress.

The nucleic acid molecules of the invention encode cell wall, cell surface and secreted proteins. They encode transcripts having the DNA sequences set forth in odd SEQ ID NOS:1-307. The amino acid sequences encoded by the nucleotide sequences of the invention are set forth in even SEQ ID NOS:1-307.

In addition to the cell wall, cell surface and secreted nucleotide sequences disclosed herein, and fragments and variants thereof, the isolated nucleic acid molecules of the current invention also encompass homologous DNA sequences identified and isolated from other organisms or cells by hybridization with entire or partial sequences obtained from the cell wall, cell surface and secreted nucleotide sequences disclosed herein, or variants and fragments thereof.

The nucleic acid and protein compositions encompassed by the present invention are isolated or substantially purified. By "isolated" or "substantially purified" is intended that the nucleic acid or protein molecules, or biologically active fragments or variants, are substantially or essentially free from components normally found in association with the nucleic acid or protein in its natural state. Such components include other cellular material, culture media from recombinant production, and various chemicals used in chemically synthesizing the proteins or nucleic acids. Preferably, an "isolated" nucleic acid of the present invention is free of nucleic acid sequences that flank the nucleic acid of interest in the genomic DNA of the organism from which the nucleic acid was derived (such as coding sequences present at the 5' or 3' ends). However, the molecule may include some additional bases or moieties that do not deleteriously affect the basic characteristics of the composition. For example, in various embodiments, the isolated nucleic acid contains less than 5 kb, 4 kb, 3 kb, 2 kb, 1 kb, 0.5 kb, or 0.1 kb of nucleic acid sequence normally associated with the genomic DNA in the cells from which it was derived. Similarly, a substantially purified protein has less than about 30%, 20%, 10%, 5%, or 1% (by dry weight) of contaminating protein, or non-cell wall, cell surface or secreted protein. When the protein is recombinantly produced, preferably culture medium represents less than 30%, 20%, 10%, or 5% of the volume of the protein preparation, and when the protein is produced chemically, preferably the preparations have less than about 30%, 20%, 10%, or 5% (by dry weight) of chemical precursors, or non-cell wall, cell surface or secreted protein chemicals.

Fragments and Variants

The invention provides isolated nucleic acid molecules comprising nucleotide sequences encoding cell wall, cell surface and secreted proteins, as well as the cell wall, cell surface and secreted proteins encoded thereby. By "cell wall, cell surface and secreted proteins" is intended proteins having the amino acid sequences set forth in even SEQ ID NOS:1-307. Fragments and variants of these nucleotide sequences and encoded proteins are also provided. By "fragment" of a nucleotide sequence or protein is intended a portion of the nucleotide or amino acid sequence.

Fragments of the nucleic acid molecules disclosed herein can be used as hybridization probes to identify cell wall, cell surface and secreted protein-encoding nucleic acids, or can be used as primers in PCR amplification or mutation of cell wall, cell surface and secreted protein nucleic acid molecules. Fragments of nucleic acids can also be bound to a physical substrate to comprise what may be considered a macro- or microarray (see, for example, U.S. Pat. No. 5,837,832; U.S. Pat. No. 5,861,242; WO 89/10977; WO 89/11548; WO 93/17126; U.S. Pat. No. 6,309,823). Such arrays of nucleic acids may be used to study gene expression or to identify nucleic acid molecules with sufficient identity to the target sequences. By "polynucleotide" or "nucleic acid molecule" is intended both sense and antisense strands of DNA molecules (e.g., cDNA or genomic DNA) and RNA molecules (e.g., mRNA) and analogs of the DNA or RNA generated using nucleotide analogs. The nucleic acid molecule can be single-stranded or double-stranded, but preferably is double-stranded DNA. A fragment of a nucleic acid molecule encoding a cell wall, cell surface and secreted protein may encode a protein fragment that is biologically active, or it may be used as a hybridization probe or PCR primer as described below. A biologically active fragment of a polypeptide disclosed herein can be prepared by isolating a portion of one of the nucleotide sequences of the invention, expressing the encoded portion of the cell wall, cell surface or secreted protein (e.g., by recombinant expression in vitro), and assessing the activity of the encoded portion of the cell wall, cell surface or secreted protein. Fragments of nucleic acid molecules encoding cell wall, cell surface and secreted proteins comprise at least about 15, 20, 50, 75, 100, 200, 250, 300, 350, 400, 450, 500, 550, 600, 650, 700, 750, 800, 850, 900, 950, 1000 nucleotides or up to the total number of nucleotides present in a full-length cell wall, cell surface or secreted nucleotide sequence as disclosed herein (for example, 918 for SEQ ID NO:1, 573 for SEQ ID NO:3, 7617 for SEQ ID NO:5, etc.).

Fragments of the nucleotide sequences of the present invention will encode protein fragments that retain the biological activity of the cell surface, cell membrane or secreted protein and, hence, retain cell surface, cell membrane or secreted protein activity. By "retains activity" is intended that the fragment will have at least about 30%, preferably at least about 50%, more preferably at least about 70%, even more preferably at least about 80% of the activity of the cell surface, cell membrane or secreted protein disclosed in even SEQ ID NOS:1-307. Methods for measuring cell surface, cell membrane or secreted activity are well known in the art. See, for example, the Example section below as well as the section entitled "Methods of Use" for examples of functional assays.

Fragments of amino acid sequences include polypeptide fragments suitable for use as immunogens to raise anti-cell wall, cell surface and secreted antibodies. Fragments include peptides comprising amino acid sequences sufficiently identical to or derived from the amino acid sequence of a cell wall, cell surface or secreted protein, or partial-length protein, of the invention and exhibiting at least one activity of a cell wall, cell surface or secreted protein, but which include fewer amino acids than the full-length cell wall, cell surface and secreted proteins disclosed herein. Typically, biologically active portions comprise a domain or motif with at least one activity of the cell wall, cell surface or secreted protein. A biologically active portion of a cell wall, cell surface or secreted protein can be a polypeptide that is, for example, 10, 25, 50, 100, 150, 200 contiguous amino acids in length, or up to the total number of amino acids present in a full-length cell wall, cell surface or secreted protein of the current invention (for example, 306 for SEQ ID NO:2, 191 for SEQ ID NO:4, 2539 for SEQ ID NO:6, etc.). Such biologically active portions can be prepared by recombinant techniques and evaluated for one or more of the functional activities of a native cell wall, cell surface or secreted protein. As used herein, a fragment comprises at least 5 contiguous amino acids of any of even SEQ ID NOS:1-307. The invention encompasses other fragments, however, such as any fragment in the protein greater than 6, 7, 8, or 9 amino acids.

Variants of the nucleotide and amino acid sequences are encompassed in the present invention. By "variant" is intended a sufficiently identical sequence. Accordingly, the invention encompasses isolated nucleic acid molecules that are sufficiently identical to the nucleotide sequences encoding cell wall, cell surface and secreted proteins in even SEQ ID NOS:1-307, or nucleic acid molecules that hybridize to a nucleic acid molecule of odd SEQ ID NOS:1-307, or a complement thereof, under stringent conditions. Variants also include polypeptides encoded by the variant nucleotide sequences of the present invention. In addition, polypeptides of the current invention have an amino acid sequence that is sufficiently identical to an amino acid sequence put forth in even SEQ ID NOS:1-307. By "sufficiently identical" is intended that one amino acid or nucleotide sequence contains a sufficient or minimal number of equivalent or identical amino acid residues as compared to a second amino acid or nucleotide sequence, thus providing a common structural domain and/or indicating a common functional activity. By "sufficiently identical" is intended an amino acid or nucleotide sequence that has at least about 45%, 55%, or 65% identity, preferably at least about 70% or 75% identity, more preferably at least about 80%, 85% or 90%, most preferably at least about 91%, 92%, 93%, 94%, 95%, 96%, 97%, 98%, or 99% sequence identity to an amino acid sequence set forth in even SEQ ID NOS:1-307, or a nucleotide sequences set forth in odd SEQ ID NOS:1-307 using one of the alignment programs described herein using standard parameters. One of skill in the art will recognize that these values can be appropriately adjusted to determine corresponding identity of proteins encoded by two nucleotide sequences by taking into account codon degeneracy, amino acid similarity, reading frame positioning, and the like.

Variant proteins encompassed by the present invention are biologically active, that is they retain the desired biological activity of the native protein, that is, one or more of the functional activities of a native cell wall, cell surface or secreted protein as described herein. By "retains activity" is intended that the variant will have at least about 30%, preferably at least about 50%, more preferably at least about 70%, even more preferably at least about 80% of the activity of the cell surface, cell membrane or secreted protein disclosed in even SEQ ID NOS:1-307. Methods for measuring cell surface, cell membrane or secreted activity are well known in the art. See, for example, the Example section below as well as the section entitled "Methods of Use" for examples of functional assays. A biologically active variant of a protein of the invention may differ from that protein by as few as 1-15 amino acid residues, as few as 1-10, such as 6-10, as few as 5, as few as 4, 3, 2, or even 1 amino acid residue.

Naturally occurring variants may exist within a population (e.g., the *L. acidophilus* population). Such variants can be identified by using well-known molecular biology techniques, such as the polymerase chain reaction (PCR), and hybridization as described below. Synthetically derived nucleotide sequences, for example, sequences generated by site-directed mutagenesis or PCR-mediated mutagenesis that still encode a cell wall, cell surface or secreted protein, are also included as variants. One or more nucleotide or amino acid substitutions, additions, or deletions can be introduced into a nucleotide or amino acid sequence disclosed herein, such that the substitutions, additions, or deletions are introduced into the encoded protein. The additions (insertions) or deletions (truncations) may be made at the N-terminal or C-terminal end of the native protein, or at one or more sites in the native protein. Similarly, a substitution of one or more nucleotides or amino acids may be made at one or more sites in the native protein.

For example, conservative amino acid substitutions may be made at one or more predicted, preferably nonessential amino acid residues. A "nonessential" amino acid residue is a residue that can be altered from the wild-type sequence of a protein without altering the biological activity, whereas an "essential" amino acid is required for biological activity. A "conservative amino acid substitution" is one in which the amino acid residue is replaced with an amino acid residue with a similar side chain. Families of amino acid residues having similar side chains are known in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Such substitutions would not be made for conserved amino acid residues, or for amino acid residues residing within a conserved motif, where such residues are essential for protein activity.

Alternatively, mutations can be made randomly along all or part of the length of the cell wall, cell surface or secreted coding sequence, such as by saturation mutagenesis. The mutants can be expressed recombinantly, and screened for those that retain biological activity by assaying for one or more of the functional activities of a native cell wall, cell surface or secreted protein using standard assay techniques. Methods for mutagenesis and nucleotide sequence alterations are known in the art. See, for example, Kunkel (1985) *Proc. Natl. Acad. Sci. USA* 82:488-492; Kunkel et al. (1987) *Methods in Enzymol. Molecular Biology* (MacMillan Publishing Company, New York) and the references sited therein. Obviously the mutations made in the DNA encoding the variant must not disrupt the reading frame and preferably will not create complimentary regions that could produce secondary mRNA structure. See, EP Patent Application Publication No. 75,444. Guidance as to appropriate amino acid substitutions that do not affect biological activity of the protein of interest may be found in the model of Dayhoff et al. (1978) *Atlas of Protein Sequence and Structure* (Natl. Biomed. Res. Found., Washington, D.C.), herein incorporated by reference.

The deletions, insertions, and substitutions of the protein sequences encompassed herein are not expected to produce radical changes in the characteristics of the protein. However, when it is difficult to predict the exact effect of the substitution, deletion, or insertion in advance of doing so, one skilled in the art will appreciate that the effect will be evaluated by routine screening assays. That is, the activity can be evaluated by comparing the activity of the modified sequence with the activity of the original sequence. For example, the modification of gusA has produced alterations in enzyme activity and enzyme stability. (see, Matsumura and Ellington (2001) *J. Mol. Biol.* 305:331-9; Flores and Ellington (2002) *J. Mol. Biol.*, 315:325-37). Similar work has been done with lactase.

Variant nucleotide and amino acid sequences of the present invention also encompass sequences derived from mutagenic and recombinogenic procedures such as DNA shuffling. With such a procedure, one or more different cell wall, cell surface and secreted protein coding regions can be used to create a new cell wall, cell surface or secreted protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the cell wall, cell surface or secreted gene of the invention and other known cell wall, cell surface or secreted genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

Variants of the cell wall, cell surface and secreted proteins can function as either cell wall, cell surface or secreted protein agonists (mimetics) or as cell wall, cell surface or secreted protein antagonists. An agonist of a cell wall, cell surface or secreted protein can retain substantially the same, or a subset, of the biological activities of a naturally occurring form of the cell wall, cell surface or secreted protein. An antagonist of a cell wall, cell surface or secreted protein can inhibit one or more of the activities of a naturally occurring form of the cell wall, cell surface or secreted protein by, for example, competitively binding to a downstream or upstream member of a cellular signaling cascade that includes the cell wall, cell surface or secreted protein.

Variants of a cell wall, cell surface or secreted protein that function as either agonists or antagonists can be identified by screening combinatorial libraries of mutants, e.g., truncation mutants, of cell wall, cell surface and secreted proteins for cell wall, cell surface and secreted protein agonist or antagonist activity. In one embodiment, a variegated library of cell wall, cell surface and secreted variants is generated by combinatorial mutagenesis at the nucleic acid level and is encoded by a variegated gene library. A variegated library of cell wall, cell surface and secreted variants can be produced by, for example, enzymatically ligating a mixture of synthetic oligonucleotides into gene sequences such that a degenerate set of potential cell wall, cell surface and secreted sequences is expressible as individual polypeptides, or alternatively, as a set of larger fusion proteins (e.g., for phage display) containing the set of cell wall, cell surface and secreted sequences therein. There are a variety of methods that can be used to produce libraries of potential cell wall, cell surface and secreted variants from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential cell wall, cell surface or secreted protein sequences. Methods for synthesizing degenerate oligonucleotides are known in the art (see, e.g., Narang (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of cell wall, cell surface and secreted protein coding sequences can be used to generate a variegated population of cell wall, cell surface and secreted fragments for screening and subsequent selection of variants of cell wall, cell surface and secreted proteins. In one embodiment, a library of coding sequence fragments can be generated by treating a double-stranded PCR fragment of a cell wall, cell surface or secreted coding sequence with a nuclease under conditions wherein nicking occurs only about once per molecule, denaturing the double-stranded DNA, renaturing the DNA to form double-stranded DNA which can include sense/antisense pairs from different nicked products, removing single-stranded portions from reformed duplexes by treatment with S1 nuclease, and ligating the resulting fragment library into an expression vector. By this method, one can derive an expression library that encodes N-terminal and internal fragments of various sizes of cell wall, cell surface and secreted proteins.

Several techniques are known in the art for screening gene products of combinatorial libraries made by point mutations or truncation and for screening cDNA libraries for gene products having a selected property. Such techniques are adaptable for rapid screening of the gene libraries generated by the combinatorial mutagenesis of cell wall, cell surface and secreted proteins. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a technique that enhances the frequency of functional mutants in the libraries, can be used in combination with the screening assays to identify cell wall, cell surface or secreted variants (Arkin and Yourvan (1992) *Proc. Natl. Acad. Sci. USA* 89:7811-7815; Delgrave et al. (1993) *Protein Engineering* 6(3):327-331).

Sequence Identity

The cell wall, cell surface and secreted sequences of Gram-positive bacteria, even though they have a diverse range of functions, and are from multiple protein families, have several common themes in their design (see, Navarre and Schneewind (1999) *Micro. Mol. Biol. Rev.* 63:174-229). N-terminal domains, which usually contain binding or catalytic activities are often followed by a number of repeat domains of various sizes, which may or may not have activity (Navarre and Schneewind (1999) *Micro. Mol. Biol. Rev.* 63:174-229). A proline-rich stretch of amino acid residues that may introduce random coils in the protein structure, and aid in traversing the peptidoglycan complex, is frequently found immediately preceding the LPXTG motif (SEQ ID NO:308, Navarre and Schneewind (1999) *Micro. Mol. Biol. Rev.* 63:174-229).

By "family" is intended two or more proteins or nucleic acid molecules having sufficient nucleotide or amino acid sequence identity. By "sequence identity" is intended the nucleotide or amino acid residues that are the same when aligning two sequences for maximum correspondence over a specified comparison window. By "comparison window" is intended a contiguous segment of the two nucleotide or amino acid sequences for optimal alignment, wherein the second sequence may contain additions or deletions (i.e., gaps) as compared to the first sequence. Generally, for nucleic acid alignments, the comparison window is at least 20 contiguous nucleotides in length, and optionally can be 30, 40, 50, 100, or longer. For amino acid sequence alignments, the comparison window is at least 6 contiguous amino acids in length, and optionally can be 10, 15, 20, 30, or longer. Those of skill in the art understand that to avoid a high similarity due to inclusion of gaps, a gap penalty is typically introduced and is subtracted from the number of matches.

Family members may be from the same or different species, and can include homologues as well as distinct proteins. Often, members of a family display common functional characteristics. Homologues can be isolated based on their identity to the *Lactobacillus acidophilus* cell wall, cell surface or secreted protein nucleic acid sequences disclosed herein using the cDNA, or a portion thereof, as a hybridization probe according to standard hybridization techniques under stringent hybridization conditions as disclosed below.

To determine the percent identity of two amino acid or nucleotide sequences, an alignment is performed. Percent identity of the two sequences is a function of the number of identical residues shared by the two sequences in the comparison window (i.e., percent identity=number of identical residues/total number of residues×100). In one embodiment, the sequences are the same length. Methods similar to those mentioned below can be used to determine the percent identity between two sequences. The methods can be used with or without allowing gaps. Alignment may also be performed manually by inspection.

When amino acid sequences differ in conservative substitutions, the percent identity may be adjusted upward to correct for the conservative nature of the substitution. Means for making this adjustment are known in the art. Typically the conservative substitution is scored as a partial, rather than a full mismatch, thereby increasing the percentage sequence identity.

Mathematical algorithms can be used to determine the percent identity of two sequences. Non-limiting examples of mathematical algorithms are the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877; the algorithm of Myers and Miller (1988) *CABIOS* 4:11-17; the local alignment algorithm of Smith et al. (1981) *Adv. Appl. Math.* 2:482; the homology alignment algorithm of Needleman and Wunsch (1970) *J. Mol. Biol.* 48:443-453; and the search-for-similarity-method of Pearson and Lipman (1988) *Proc. Natl. Acad. Sci. USA* 85:2444-2448.

Various computer implementations based on these mathematical algorithms have been designed to enable the determination of sequence identity. The BLAST programs of Altschul et al. (1990) *J. Mol. Biol.* 215:403 are based on the algorithm of Karlin and Altschul (1990) supra. Searches to obtain nucleotide sequences that are homologous to nucleotide sequences of the present invention can be performed with the BLASTN program, score=100, wordlength=12. To obtain amino acid sequences homologous to sequences encoding a protein or polypeptide of the current invention, the BLASTX program may be used, score=50, wordlength=3. Gapped alignments may be obtained by using Gapped BLAST as described in Altschul et al. (1997) *Nucleic Acids Res.* 25:3389. To detect distant relationships between molecules, PSI-BLAST can be used. See, Altschul et al. (1997) supra. For all of the BLAST programs, the default parameters of the respective programs can be used. See, www.ncbi.nlm.nih.gov.

Another program that can be used to determine percent sequence identity is the ALIGN program (version 2.0), which uses the mathematical algorithm of Myers and Miller (1988) supra. A PAM120 weight residue table, a gap length penalty of 12, and a gap penalty of 4 can be used with this program when comparing amino acid sequences.

In addition to the ALIGN and BLAST programs, the BESTFIT, GAP, FASTA and TFASTA programs are part of the Wisconsin Genetics Software Package (from GCG, Madison, Wis.), and can be used for performing sequence alignments. The preferred program is GAP version 10, which used the algorithm of Needleman and Wunsch (1970) supra. Unless otherwise stated the sequence identity similarity values provided herein refer to the value obtained using GAP Version 10 with the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Identification and Isolation of Homologous Sequences

Cell wall, cell surface and secreted nucleotide sequences identified based on their sequence identity to the cell wall, cell surface and secreted nucleotide sequences set forth herein or to fragments and variants thereof are encompassed by the present invention. Methods such as PCR or hybridization can be used to identify sequences from a cDNA or genomic library, for example, that are substantially identical to a sequence of the invention. See, for example, Sambrook et al. (1989) *Molecular Cloning: Laboratory Manual* (2d ed., Cold Spring Harbor Laboratory Press, Plainview, N.Y.) and Innis, et al. (1990) *PCR Protocols: A Guide to Methods and Applications* (Academic Press, New York). Methods for construction of such cDNA and genomic libraries are generally known in the art and are also disclosed in the above reference.

In hybridization techniques, the hybridization probes may be genomic DNA fragments, cDNA fragments, RNA fragments, or other oligonucleotides, and may consist of all or part of a known nucleotide sequence disclosed herein. In addition, they may be labeled with a detectable group such as $^{32}P$, or any other detectable marker, such as other radioisotopes, a fluorescent compound, an enzyme, or an enzyme co-factor. Probes for hybridization can be made by labeling synthetic oligonucleotides based on the known cell wall, cell surface and secreted nucleotide sequences disclosed herein. Degenerate primers designed on the basis of conserved nucleotides or amino acid residues in a known cell wall, cell surface and secreted nucleotide sequence or encoded amino acid sequence can additionally be used. The hybridization probe typically comprises a region of nucleotide sequence that hybridizes under stringent conditions to at least about 10, preferably about 20, more preferably about 50, 75, 100, 125, 150, 175, 200, 250, 300, 350, or 400 consecutive nucleotides of a cell wall, cell surface or secreted protein nucleotide sequence of the invention or a fragment or variant thereof. To achieve specific hybridization under a variety of conditions, such probes include sequences that are unique among cell wall, cell surface or secreted protein sequences. Preparation of probes for hybridization is generally known in the art and is disclosed in Sambrook et al. (1989) *Molecular Cloning: A Laboratory Manual* (2d ed., Cold Spring Harbor Laboratory Press, Plainview, N.Y.), herein incorporated by reference.

In one embodiment, the entire nucleotide sequence encoding a cell wall, cell surface or secreted protein is used as a probe to identify novel cell wall, cell surface or secreted sequences and messenger RNAs. In another embodiment, the probe is a fragment of a nucleotide sequence disclosed herein. In some embodiments, the nucleotide sequence that hybridizes under stringent conditions to the probe can be at least about 300, 325, 350, 375, 400, 425, 450, 500, 550, 600, 650, 700, 800, 900, 1000, 2000, 3000, 4000, 5000, 6000, 7000, 8000, 9000, 10,000, 11,000, 12,000, or 12,500 nucleotides in length.

Substantially identical sequences will hybridize to each other under stringent conditions. By "stringent conditions" is intended conditions under which a probe will hybridize to its target sequence to a detectably greater degree than to other sequences (e.g., at least 2-fold over background). Generally, stringent conditions encompass those conditions for hybridization and washing under which nucleotides having at least about 60%, 65%, 70%, preferably 75% sequence identity typically remain hybridized to each other. Stringent conditions are known in the art and can be found in *Current Protocols in Molecular Biology* (John Wiley & Sons, New York (1989)), 6.3.1-6.3.6. Hybridization typically occurs for less than about 24 hours, usually about 4 to about 12 hours.

Stringent conditions are sequence-dependent and will differ in different circumstances. Full-length or partial nucleic acid sequences may be used to obtain homologues and orthologs encompassed by the present invention. By "orthologs" is intended genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

When using probes, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides).

The post-hybridization washes are instrumental in controlling specificity. The two critical factors are ionic strength and temperature of the final wash solution. For the detection of sequences that hybridize to a full-length or approximately full-length target sequence, the temperature under stringent conditions is selected to be about 5° C. lower than the thermal melting point ($T_m$) for the specific sequence at a defined ionic strength and pH. However, stringent conditions would encompass temperatures in the range of 1° C. to 20° C. lower than the $T_m$, depending on the desired degree of stringency as otherwise qualified herein. For DNA-DNA hybrids, the $T_m$ can be determined using the equation of Meinkoth and Wahl (1984) *Anal. Biochem.* 138:267-284: $T_m = 81.5°$ C.$+16.6$ (logM)$+0.41$ (% GC)$-0.61$ (% form)$-500/L$; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe.

The ability to detect sequences with varying degrees of homology can be obtained by varying the stringency of the hybridization and/or washing conditions. To target sequences that are 100% identical (homologous probing), stringency conditions must be obtained that do not allow mismatching. By allowing mismatching of nucleotide residues to occur, sequences with a lower degree of similarity can be detected (heterologous probing). For every 1% of mismatching, the $T_m$ is reduced about 1° C.; therefore, hybridization and/or wash conditions can be manipulated to allow hybridization of sequences of a target percentage identity. For example, if sequences with ≧90% sequence identity are preferred, the $T_m$ can be decreased by 10° C. Two nucleotide sequences could be substantially identical, but fail to hybridize to each other under stringent conditions, if the polypeptides they encode are substantially identical. This situation could arise, for example, if the maximum codon degeneracy of the genetic code is used to create a copy of a nucleic acid.

Exemplary low stringency conditions include hybridization with a buffer solution of 30-35% formamide, 1 M NaCl, 1% SDS (sodium dodecyl sulfate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed.; Cold Spring Harbor Laboratory Press, Plainview, N.Y.).

In a PCR approach, oligonucleotide primers can be designed for use in PCR reactions to amplify corresponding DNA sequences from cDNA or genomic DNA extracted from any organism of interest. PCR primers are preferably at least about 10 nucleotides in length, and most preferably at least about 20 nucleotides in length. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

Assays

Diagnostic assays to detect expression of the disclosed polypeptides and/or nucleic acid molecules as well as their disclosed activity in a sample are disclosed. An exemplary method for detecting the presence or absence of a disclosed nucleic acid or protein comprising the disclosed polypeptide in a sample involves obtaining a sample from a food/dairy/feed product, starter culture (mother, seed, bulk/set, concentrated, dried, lyophilized, frozen), cultured food/dairy/feed product, dietary supplement, bioprocessing fermentate, or a subject that has ingested a probiotic material and contacting the sample with a compound or an agent capable of detecting the disclosed polypeptides or nucleic acids (e.g., an mRNA or genomic DNA comprising the disclosed nucleic acid or fragment thereof) such that the presence of the disclosed sequence is detected in the sample. Results obtained with a sample from the food, supplement, culture, product, or subject may be compared to results obtained with a sample from a control culture, product, or subject.

One agent for detecting the mRNA or genomic DNA comprising a disclosed nucleotide sequence is a labeled nucleic acid probe capable of hybridizing to the disclosed nucleotide sequence of the mRNA or genomic DNA. The nucleic acid probe can be, for example, a disclosed nucleic acid molecule, such as the nucleic acid of odd SEQ ID NOS:1-307, or a portion thereof, such as a nucleic acid molecule of at least 15, 30, 50, 100, 250, or 500 nucleotides in length and sufficient to specifically hybridize under stringent conditions to the mRNA or genomic DNA comprising the disclosed nucleic acid sequence. Other suitable probes for use in the diagnostic assays of the invention are described herein.

One agent for detecting a protein comprising a disclosed polypeptide sequence is an antibody capable of binding to the disclosed polypeptide, preferably an antibody with a detectable label. Antibodies can be polyclonal, or more preferably, monoclonal. An intact antibody, or a fragment thereof (e.g., Fab or $F(ab')_2$) can be used. The term "labeled," with regard to the probe or antibody, is intended to encompass direct labeling of the probe or antibody by coupling (i.e., physically linking) a detectable substance to the probe or antibody, as well as indirect labeling of the probe or antibody by reactivity with another reagent that is directly labeled. Examples of indirect labeling include detection of a primary antibody using a fluorescently labeled secondary antibody and end labeling of a DNA probe with biotin such that it can be detected with fluorescently labeled streptavidin.

The term "sample" is intended to include tissues, cells, and biological fluids present in or isolated from a subject, as well as cells from starter cultures or food products carrying such cultures, or derived from the use of such cultures. That is, the detection method of the invention can be used to detect mRNA, protein, or genomic DNA comprising a disclosed sequence in a sample both in vitro and in vivo. In vitro techniques for detection of mRNA comprising a disclosed sequence include Northern hybridizations and in situ hybridizations. In vitro techniques for detection of a protein comprising a disclosed polypeptide include enzyme linked immunosorbent assays (ELISAs), Western blots, immunoprecipitations, and immunofluorescence. In vitro techniques for detection of genomic DNA comprising the disclosed nucleotide sequences include Southern hybridizations. Furthermore, in vivo techniques for detection of a protein comprising a disclosed polypeptide include introducing into a subject a labeled antibody against the disclosed polypeptide. For example, the antibody can be labeled with a radioactive marker whose presence and location in a subject can be detected by standard imaging techniques.

In one embodiment, the sample contains protein molecules from a test subject that has consumed a probiotic material. Alternatively, the sample can contain mRNA or genomic DNA from a starter culture.

The invention also encompasses kits for detecting the presence of disclosed nucleic acids or proteins comprising disclosed polypeptides in a sample. Such kits can be used to determine if a microbe expressing a specific polypeptide of the invention is present in a food product or starter culture, or in a subject that has consumed a probiotic material. For example, the kit can comprise a labeled compound or agent capable of detecting a disclosed polypeptide or mRNA in a sample and means for determining the amount of a disclosed polypeptide in the sample (e.g., an antibody that recognizes the disclosed polypeptide or an oligonucleotide probe that binds to DNA encoding a disclosed polypeptide, e.g., any of even SEQ ID NOS:1-307. Kits can also include instructions detailing the use of such compounds.

For antibody-based kits, the kit can comprise, for example: (1) a first antibody (e.g., attached to a solid support) that binds to a disclosed polypeptide; and, optionally, (2) a second, different antibody that binds to the disclosed polypeptide or the first antibody and is conjugated to a detectable agent. For oligonucleotide-based kits, the kit can comprise, for example: (1) an oligonucleotide, e.g., a detectably labeled oligonucleotide, that hybridizes to a disclosed nucleic acid sequence or (2) a pair of primers useful for amplifying a disclosed nucleic acid molecule.

The kit can also comprise, e.g., a buffering agent, a preservative, or a protein-stabilizing agent. The kit can also comprise components necessary for detecting the detectable agent (e.g., an enzyme or a substrate). The kit can also contain a control sample or a series of control samples that can be assayed and compared to the test sample contained. Each component of the kit is usually enclosed within an individual container, and all of the various containers are within a single package along with instructions for use.

In one embodiment, the kit comprises multiple probes in an array format, such as those described, for example, in U.S. Pat. Nos. 5,412,087 and 5,545,531, and International Publication No. WO 95/00530, herein incorporated by reference. Probes for use in the array may be synthesized either directly onto the surface of the array, as disclosed in International Publication No. WO 95/00530, or prior to immobilization onto the array surface (Gait, ed. (1984) *Oligonucleotide Synthesis a Practical Approach* IRL Press, Oxford, England). The probes may be immobilized onto the surface using techniques well known to one of skill in the art, such as those described in U.S. Pat. No. 5,412,087. Probes may be a nucleic acid or peptide sequence, preferably purified, or an antibody.

The arrays may be used to screen organisms, samples, or products for differences in their genomic, cDNA, polypeptide, or antibody content, including the presence or absence of specific sequences or proteins, as well as the concentration of those materials. Binding to a capture probe is detected, for example, by signal generated from a label attached to the nucleic acid molecule comprising the disclosed nucleic acid sequence, a polypeptide comprising the disclosed amino acid sequence, or an antibody. The method can include contacting the molecule comprising the disclosed nucleic acid, polypeptide, or antibody with a first array having a plurality of capture probes and a second array having a different plurality of capture probes. The results of each hybridization can be compared to analyze differences in expression between a first and second sample. The first plurality of capture probes can be from a control sample, e.g., a wild type lactic acid bacteria, or control subject, e.g., a food, dietary supplement, starter culture sample, or a biological fluid. The second plurality of capture probes can be from an experimental sample, e.g., a mutant type lactic acid bacteria, or subject that has consumed a probiotic material, e.g., a starter culture sample or a biological fluid.

These assays may be especially useful in microbial selection and quality control procedures where the detection of unwanted materials is essential. The detection of particular nucleotide sequences or polypeptides may also be useful in determining the genetic composition of food, fermentation products, or industrial microbes, or microbes present in the digestive system of animals or humans that have consumed probiotics.

Antisense Nucleotide Sequences

The present invention also encompasses antisense nucleic acid molecules, i.e., molecules that are complementary to a sense nucleic acid encoding a protein, e.g., complementary to the coding strand of a double-stranded cDNA molecule, or complementary to an mRNA sequence. Accordingly, an antisense nucleic acid can hydrogen bond to a sense nucleic acid. The antisense nucleic acid can be complementary to an entire cell wall, cell surface or secreted protein coding strand, or to only a portion thereof, e.g., all or part of the protein-coding region (or open reading frame). An antisense nucleic acid molecule can be antisense to a noncoding region of the coding strand of a nucleotide sequence encoding a cell wall, cell surface or secreted protein. The non-coding regions are the 5' and 3' sequences that flank the coding region and are not translated into amino acids. Antisense nucleotide sequences are useful in disrupting the expression of the target gene. Antisense constructions having 70%, preferably 80%, more preferably 85% sequence identity to the corresponding sequence may be used.

Given the coding-strand sequence encoding a cell wall, cell surface or secreted protein disclosed herein (e.g., odd SEQ ID NOS:1-307), antisense nucleic acids of the invention can be designed according to the rules of Watson and Crick base pairing. The antisense nucleic acid molecule can be complementary to the entire coding region of cell wall, cell surface or secreted protein mRNA, but more preferably is an oligonucleotide that is antisense to only a portion of the coding or noncoding region of cell wall, cell surface or secreted protein mRNA. For example, the antisense oligonucleotide can be complementary to the region surrounding the translation start site of cell wall, cell surface or secreted protein mRNA. An antisense oligonucleotide can be, for example, about 5, 10, 15, 20, 25, 30, 35, 40, 45, or 50 nucleotides in length, or it can be 100, 200 nucleotides, or greater in length. An antisense nucleic acid of the invention can be constructed using chemical synthesis and enzymatic ligation procedures known in the art.

For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, including, but not limited to, for example e.g., phosphorothioate derivatives and acridine substituted nucleotides. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest).

An antisense nucleic acid molecule of the invention can be an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

The invention also encompasses ribozymes, which are catalytic RNA molecules with ribonuclease activity that are capable of cleaving a single-stranded nucleic acid, such as an mRNA, to which they have a complementary region. Ribozymes (e.g., hammerhead ribozymes (described in Haselhoff and Gerlach (1988) *Nature* 334:585-591)) can be used to catalytically cleave cell wall, cell surface and secreted mRNA transcripts to thereby inhibit translation of cell wall, cell surface and secreted mRNA. A ribozyme having specificity for a cell wall, cell surface or secreted protein-encoding nucleic acid can be designed based upon the nucleotide sequence of a cell wall, cell surface or secreted protein cDNA disclosed herein (e.g., odd SEQ ID NOS:1-307). See, e.g., U.S. Pat. No. 4,987,071; and U.S. Pat. No. 5,116,742. Alternatively, cell wall, cell surface and secreted protein mRNA can be used to select a catalytic RNA having a specific ribonuclease activity from a pool of RNA molecules. See, e.g., Bartel and Szostak (1993) *Science* 261:1411-1418.

The invention also encompasses nucleic acid molecules that form triple helical structures. For example, cell wall, cell surface or secreted protein gene expression can be inhibited by targeting nucleotide sequences complementary to the regulatory region of the cell wall, cell surface or secreted protein (e.g., the cell wall, cell surface or secreted promoters and/or enhancers) to form triple helical structures that prevent transcription of the cell wall, cell surface or secreted protein gene in target cells. See generally Helene (1991) *Anticancer Drug Des*. 6(6):569; Helene (1992) *Ann. N.Y. Acad. Sci*. 660:27; and Maher (1992) *Bioassays* 14(12): 807.

In some embodiments, the nucleic acid molecules of the invention can be modified at the base moiety, sugar moiety, or phosphate backbone to improve, e.g., the stability, hybridization, or solubility of the molecule. For example, the deoxyribose phosphate backbone of the nucleic acids can be modified to generate peptide nucleic acids (see Hyrup et al. (1996) *Bioorganic & Medicinal Chemistry* 4:5). As used herein, the terms "peptide nucleic acids" or "PNAs" refer to nucleic acid mimics, e.g., DNA mimics, in which the deoxyribose phosphate backbone is replaced by a pseudopeptide backbone and only the four natural nucleobases are retained. The neutral backbone of PNAs has been shown to allow for specific hybridization to DNA and RNA under conditions of low ionic strength. The synthesis of PNA oligomers can be performed using standard solid-phase peptide synthesis protocols as described, for example, in Hyrup et al. (1996) supra; Perry-O'Keefe et al. (1996) *Proc. Natl. Acad. Sci. USA* 93:14670.

PNAs can be used as antisense or antigene agents for sequence-specific modulation of gene expression by, e.g., inducing transcription or translation arrest or inhibiting replication. PNAs of the invention can also be used, e.g., in the analysis of single base pair mutations in a gene by, e.g., PNA-directed PCR clamping; as artificial restriction enzymes when used in combination with other enzymes, e.g., S1 nucleases (Hyrup (1996) supra); or as probes or primers for DNA sequence and hybridization (Hyrup (1996) supra; Perry-O'Keefe et al. (1996) supra).

In another embodiment, PNAs of a cell wall, cell surface or secreted molecule can be modified, e.g., to enhance their stability, specificity, or cellular uptake, by attaching lipophilic or other helper groups to PNA, by the formation of PNA-DNA chimeras, or by the use of liposomes or other techniques of drug delivery known in the art. The synthesis of PNA-DNA chimeras can be performed as described in Hyrup (1996) supra; Finn et al. (1996) *Nucleic Acids Res*. 24(17):3357-63; Mag et al. (1989) *Nucleic Acids Res*. 17:5973; and Peterson et al. (1975) *Bioorganic Med. Chem. Lett*. 5:1119.

Fusion Proteins

The invention also includes cell wall, cell surface and secreted chimeric or fusion proteins. A cell wall, cell surface or secreted "chimeric protein" or "fusion protein" comprises a cell wall, cell surface or secreted polypeptide operably linked to a non-cell wall, cell surface or secreted polypeptide. A "cell wall, cell surface or secreted polypeptide" refers to a polypeptide having an amino acid sequence corresponding to a cell wall, cell surface or secreted protein, whereas a "non-cell wall, cell surface or secreted polypeptide" refers to a polypeptide having an amino acid sequence corresponding to a protein that is not substantially identical to the cell wall, cell surface or secreted protein, and which is derived from the same or a different organism. Within a cell wall, cell surface or secreted fusion protein, the (cell wall, cell surface or secreted polypeptide can correspond to all or a portion of a cell wall, cell surface or secreted protein, preferably including at least one biologically active portion of a cell wall, cell surface or secreted protein. Within the fusion protein, the term "operably linked" is intended to indicate that the cell wall, cell surface or secreted polypeptide and the non-cell wall, cell surface or secreted polypeptide are fused in-frame to each other. The non-cell wall, cell surface or secreted polypeptide can be fused to the N-terminus or C-terminus of the cell wall, cell surface or secreted polypeptide.

Expression of the linked coding sequences results in two linked heterologous amino acid sequences that form the fusion protein. The carrier sequence (the non-cell wall, cell surface or secreted polypeptide) can encode a carrier polypeptide that potentiates or increases expression of the fusion protein in the bacterial host. The portion of the fusion protein encoded by the carrier sequence, i.e., the carrier polypeptide, may be a protein fragment, an entire functional moiety, or an entire protein sequence. The carrier region or polypeptide may additionally be designed to be used in purifying the fusion protein, either with antibodies or with affinity purification specific for that carrier polypeptide. Likewise, physical properties of the carrier polypeptide can be exploited to allow selective purification of the fusion protein.

Particular carrier polypeptides of interest include superoxide dismutase (SOD), maltose-binding protein (MBP), glutathione-S-transferase (GST), an N-terminal histidine (His) tag, and the like. This list is not intended to be limiting, as any carrier polypeptide that potentiates expression of the cell wall, cell surface or secreted protein as a fusion protein can be used in the methods of the invention.

In one embodiment, the fusion protein is a GST-cell wall, cell surface or secreted fusion protein in which the cell wall, cell surface or secreted sequence is fused to the C-terminus of the GST sequence. In another embodiment, the fusion protein is a cell wall, cell surface or secreted-immunoglobulin fusion protein in which all or part of a cell wall, cell surface or secreted protein is fused to sequences derived from a member of the immunoglobulin protein family. The cell wall, cell surface or secreted protein-immunoglobulin fusion proteins of the invention can be used as immunogens to produce anti-cell wall, cell surface or secreted antibodies in a subject, to purify cell wall, cell surface or secreted protein ligands, and in screening assays to identify molecules that inhibit the interaction of a cell wall, cell surface or secreted protein with a cell wall, cell surface or secreted protein ligand.

One of skill in the art will recognize that the particular carrier polypeptide is chosen with the purification scheme in mind. For example, His tags, GST, and maltose-binding protein represent carrier polypeptides that have readily available affinity columns to which they can be bound and eluted. Thus, where the carrier polypeptide is an N-terminal His tag such as hexahistidine (His$_6$ tag), the cell wall, cell surface or secreted fusion protein can be purified using a matrix comprising a metal-chelating resin, for example, nickel nitrilotriacetic acid (Ni-NTA), nickel iminodiacetic acid (Ni-IDA), and cobalt-containing resin (Co-resin). See, for example, Steinert et al. (1997) *QIAGEN News* 4:11-15, herein incorporated by reference in its entirety. Where the carrier polypeptide is GST, the cell wall, cell surface or secreted fusion protein can be purified using a matrix comprising glutathione-agarose beads (Sigma or Pharmacia Biotech); where the carrier polypeptide is a maltose-binding protein (MBP), the cell wall, cell surface or secreted fusion protein can be purified using a matrix comprising an agarose resin derivatized with amylose.

Preferably, a chimeric or fusion protein of the invention is produced by standard recombinant DNA techniques. For example, DNA fragments coding for the different polypeptide sequences may be ligated together in-frame, or the fusion gene can be synthesized, such as with automated DNA synthesizers. Alternatively, PCR amplification of gene fragments can be carried out using anchor primers that give rise to complementary overhangs between two consecutive gene fragments, which can subsequently be annealed and re-amplified to generate a chimeric gene sequence (see, e.g., Ausubel et al., eds. (1995) *Current Protocols in Molecular Biology* (Greene Publishing and Wiley-Interscience, New York). Moreover, a cell wall, cell surface or secreted protein-encoding nucleic acid can be cloned into a commercially available expression vector such that it is linked in-frame to an existing fusion moiety.

The fusion protein expression vector is typically designed for ease of removing the carrier polypeptide to allow the cell wall, cell surface or secreted protein to retain the native biological activity associated with it. Methods for cleavage of fusion proteins are known in the art. See, for example, Ausubel et al., eds. (1998) *Current Protocols in Molecular Biology* (John Wiley & Sons, Inc.). Chemical cleavage of the fusion protein can be accomplished with reagents such as cyanogen bromide, 2-(2-nitrophenylsulphenyl)-3-methyl-3'-bromoindolenine, hydroxylamine, or low pH. Chemical cleavage is often accomplished under denaturing conditions to cleave otherwise insoluble fusion proteins.

Where separation of the cell wall, cell surface or secreted polypeptide from the carrier polypeptide is desired and a cleavage site at the junction between these fused polypeptides is not naturally occurring, the fusion construct can be designed to contain a specific protease cleavage site to facilitate enzymatic cleavage and removal of the carrier polypeptide. In this manner, a linker sequence comprising a coding sequence for a peptide that has a cleavage site specific for an enzyme of interest can be fused in-frame between the coding sequence for the carrier polypeptide (for example, MBP, GST, SOD, or an N-terminal His tag) and the coding sequence for the cell wall, cell surface or secreted polypeptide. Suitable enzymes having specificity for cleavage sites include, but are not limited to, factor Xa, thrombin, enterokinase, remin, collagenase, and tobacco etch virus (TEV) protease. Cleavage sites for these enzymes are well known in the art. Thus, for example, where factor Xa is to be used to cleave the carrier polypeptide from the cell wall, cell surface or secreted polypeptide, the fusion construct can be designed to comprise a linker sequence encoding a factor Xa-sensitive cleavage site, for example, the sequence IEGR (see, for example, Nagai and Thøgersen (1984) *Nature* 309:810-812, Nagai and Thøgersen (1987) *Meth. Enzymol.* 153:461-481, and Pryor and Leiting (1997) *Protein Expr. Purif.* 10(3):309-319, herein incorporated by reference). Where thrombin is to be used to cleave the carrier polypeptide from the cell wall, cell surface and secreted polypeptide, the fusion construct can be designed to comprise a linker sequence encoding a thrombin-sensitive cleavage site, for example the sequence LVPRGS or VIAGR (see, for example, Pryor and Leiting (1997) *Protein Expr. Purif.* 10(3):309-319, and Hong et al. (1997) *Chin. Med. Sci. J.* 12(3):143-147, respectively, herein incorporated by reference). Cleavage sites for TEV protease are known in the art. See, for example, the cleavage sites described in U.S. Pat. No. 5,532,142, herein incorporated by reference in its entirety. See also the discussion in Ausubel et al., eds. (1998) *Current Protocols in Molecular Biology* (John Wiley & Sons, Inc.), Chapter 16.

Fusion proteins of the invention can utilize all or part of the "cell wall, cell surface or secreted protein" to target foreign peptides and proteins to the cell wall, cell surface or for secretion. Targeting to the cell wall, cell surface or for secretion by the cell results from signal sequences, secretion signals, or LPXTG-like (SEQ ID NO:308) motifs in the cell wall, cell surface or secreted protein. The functional region which allows the native cell wall, cell surface or secreted protein to be secreted or bound at the cell wall or cell surface can be fused as described below in such a way as to enable a non-cell wall, cell surface or secreted protein to be secreted or bound to the cell wall or cell surface of the same or a different organism.

Antibodies

An isolated polypeptide of the present invention can be used as an immunogen to generate antibodies that specifically bind cell wall, cell surface or secreted proteins, or stimulate production of antibodies in vivo. The full-length cell wall, cell surface or secreted protein can be used as an immunogen or, alternatively, antigenic peptide fragments of cell wall, cell surface or secreted proteins as described herein can be used. The antigenic peptide of a cell wall, cell surface or secreted protein comprises at least 8, preferably 10, 15, 20, or 30 amino acid residues of the amino acid sequence shown in any of even SEQ ID NOS:1-307, and encompasses an epitope of a cell wall, cell surface or secreted protein such that an antibody raised against the peptide forms a specific immune complex with the cell wall, cell surface or secreted protein. Preferred epitopes encompassed by the antigenic peptide are regions of a cell wall, cell surface or secreted protein that are located on the surface of the protein, e.g., hydrophilic regions.

Recombinant Expression Vectors and Host Cells

The nucleic acid molecules of the present invention may be included in vectors, preferably expression vectors. "Vector" refers to a nucleic acid molecule capable of transporting another nucleic acid to which it has been linked. Expression vectors include one or more regulatory sequences and direct the expression of genes to which they are operably linked. By "operably linked" is intended that the nucleotide sequence of interest is linked to the regulatory sequence(s) such that expression of the nucleotide sequence is allowed (e.g., in an in vitro transcription/translation system or in a host cell when the vector is introduced into the host cell). The term "regulatory sequence" is intended to include controllable transcriptional promoters, operators, enhancers, transcriptional terminators, and other expression control elements such as translational control sequences (e.g., Shine-Dalgamo consensus sequence, initiation and termination codons). These regulatory sequences will differ, for example, depending on the host cell being used.

The vectors can be autonomously replicated in a host cell (episomal vectors), or may be integrated into the genome of a host cell, and replicated along with the host genome (non-episomal mammalian vectors). Integrating vectors typically contain at least one sequence homologous to the bacterial chromosome that allows for recombination to occur between homologous DNA in the vector and the bacterial chromosome. Integrating vectors may also comprise bacteriophage or transposon sequences. Episomal vectors, or plasmids are circular double-stranded DNA loops into which additional DNA segments can be ligated. Plasmids capable of stable maintenance in a host are generally the preferred form of expression vectors when using recombinant DNA techniques.

The expression constructs or vectors encompassed in the present invention comprise a nucleic acid construct of the invention in a form suitable for expression of the nucleic acid in a host cell. Expression in prokaryotic host cells is encompassed in the present invention. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., cell wall, cell surface and secreted proteins, mutant forms of cell wall, cell surface and secreted proteins, fusion proteins, etc.).

Regulatory sequences include those that direct constitutive expression of a nucleotide sequence as well as those that direct inducible expression of the nucleotide sequence only under certain environmental conditions. A bacterial promoter is any DNA sequence capable of binding bacterial RNA polymerase and initiating the downstream (3') transcription of a coding sequence (e.g., structural gene) into mRNA. A promoter will have a transcription initiation region, which is usually placed proximal to the 5' end of the coding sequence. This transcription initiation region typically includes an RNA polymerase binding site and a transcription initiation site. A bacterial promoter may also have a second domain called an operator, which may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence.

An example of a gene activator protein is the catabolite activator protein (CAP), which helps initiate transcription of the lac operon in *Escherichia coli* (Raibaud et al. (1984) *Annu. Rev. Genet.* 18:173). Regulated expression may therefore be positive or negative, thereby either enhancing or reducing transcription. Other examples of positive and negative regulatory elements are well known in the art. Various promoters that can be included in the protein expression system include, but are not limited to, a T7/LacO hybrid promoter, a trp promoter, a T7 promoter, a lac promoter, and a bacteriophage lambda promoter. Any suitable promoter can be used to carry out the present invention, including the native promoter or a heterologous promoter. Heterologous promoters may be constitutively active or inducible. A non-limiting example of a heterologous promoter is given in U.S. Pat. No. 6,242,194.

Sequences encoding metabolic pathway enzymes provide particularly useful promoter sequences. Examples include promoter sequences derived from sugar metabolizing enzymes, such as galactose, lactose (lac) (Chang et al. (1987) *Nature* 198:1056), and maltose. Additional examples include promoter sequences derived from biosynthetic enzymes such as tryptophan (trp) (Goeddel et al. (1980) *Nucleic Acids Res.* 8:4057; Yelverton et al. (1981) *Nucleic Acids Res.* 9:731; U.S. Pat. No. 4,738,921; EPO Publication Nos. 36,776 and 121,775). The beta-lactamase (bla) promoter system (Weissmann, (1981) "The Cloning of Interferon and Other Mistakes," in *Interferon* 3 (ed. I. Gresser); bacteriophage lambda PL (Shimatake et al. (1981) *Nature* 292:128); the arabinose-inducible araB promoter (U.S. Pat. No. 5,028,530); and T5 (U.S. Pat. No. 4,689,406) promoter systems also provide useful promoter sequences. See also Balbas (2001) *Mol. Biotech.* 19:251-267, where *E. coli* expression systems are discussed.

In addition, synthetic promoters that do not occur in nature also function as bacterial promoters. For example, transcription activation sequences of one bacterial or bacteriophage promoter may be joined with the operon sequences of another bacterial or bacteriophage promoter, creating a synthetic hybrid promoter (U.S. Pat. No. 4,551,433). For example, the tac (Amann et al. (1983) *Gene* 25:167; de Boer et al. (1983) *Proc. Natl. Acad. Sci.* 80:21) and trc (Brosius et al. (1985) *J. Biol. Chem.* 260:3539-3541) promoters are hybrid trp-lac promoters comprised of both trp promoter and lac operon sequences that are regulated by the lac repressor. The tac promoter has the additional feature of being an inducible regulatory sequence. Thus, for example, expression of a coding sequence operably linked to the tac promoter can be induced in a cell culture by adding isopropyl-1-thio-β-D-galactoside (IPTG). Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system (Studier et al. (1986) *J. Mol. Biol.* 189:113; Tabor et al. (1985) *Proc. Natl. Acad. Sci.* 82:1074). In addition, a hybrid promoter can also be comprised of a bacteriophage promoter and an *E. coli* operator region (EPO Publication No. 267,851).

The vector may additionally contain a gene encoding the repressor (or inducer) for that promoter. For example, an inducible vector of the present invention may regulate transcription from the Lac operator (LacO) by expressing the gene encoding the LacI repressor protein. Other examples include the use of the lexa gene to regulate expression of pRecA, and the use of trpO to regulate ptrp. Alleles of such genes that increase the extent of repression (e.g., lacIq) or that modify the manner of induction (e.g., .lambda.CI857, rendering .lambda.pL thermo-inducible, or .lambda.CI+, rendering .lambda.pL chemo-inducible) may be employed.

In addition to a functioning promoter sequence, an efficient ribosome-binding site is also useful for the expression of the fusion construct. In prokaryotes, the ribosome binding site is called the Shine-Dalgamo (SD) sequence and includes an initiation codon (ATG) and a sequence 3-9 nucleotides in length located 3-11 nucleotides upstream of the initiation codon (Shine et al. (1975) *Nature* 254:34). The SD sequence is thought to promote binding of mRNA to the ribosome by the pairing of bases between the SD sequence and the 3' end of bacterial 16S rRNA (Steitz et al. (1979) "Genetic Signals and Nucleotide Sequences in Messenger RNA," in *Biological Regulation and Development: Gene Expression* (ed. R. F. Goldberger, Plenum Press, NY).

Cell wall and cell surface proteins can also be secreted from the cell by creating chimeric DNA molecules that encode a protein comprising a signal peptide sequence fragment that provides for secretion of the cell wall or cell surface polypeptides in bacteria (U.S. Pat. No. 4,336,336). The signal sequence fragment typically encodes a signal peptide comprised of hydrophobic amino acids that direct the secretion of the protein from the cell. The protein is either secreted into the growth media (Gram-positive bacteria) or into the periplasmic space, located between the inner and outer membrane of the cell (Gram-negative bacteria). Preferably there are processing sites, which can be cleaved either in vivo or in vitro, encoded between the signal peptide fragment and the cell wall, cell surface and secreted protein.

DNA encoding suitable signal sequences can be derived from genes for secreted bacterial proteins, such as the *E. coli* outer membrane protein gene (ompA) (Masui et al. (1983) FEBS Lett. 151(1):159-164; Ghrayeb et al. (1984) *EMBO J.* 3:2437-2442) and the *E. coli* alkaline phosphatase signal sequence (phoA) (Oka et al. (1985) *Proc. Natl. Acad. Sci.* 82:7212). Other prokaryotic signals include, for example, the signal sequence from penicillinase, Ipp, or heat stable enterotoxin II leaders.

Bacteria such as *L. acidophilus* generally utilize the start codon ATG, which specifies the amino acid methionine (which is modified to N-formylmethionine in prokaryotic organisms). Bacteria also recognize alternative start codons, such as the codons GTG and TTG, which code for valine and leucine, respectively. When they are used as the initiation codon, however, these codons direct the incorporation of methionine rather than of the amino acid they normally encode. *Lactobacillus acidophilus* NCFM recognizes these alternative start sites and incorporates methionine as the first amino acid.

Typically, transcription termination sequences recognized by bacteria are regulatory regions located 3' to the translation stop codon and thus, together with the promoter, flank the coding sequence. These sequences direct the transcription of an mRNA that can be translated into the polypeptide encoded by the DNA. Transcription termination sequences frequently include DNA sequences (of about 50 nucleotides) that are capable of forming stem loop structures that aid in terminating transcription. Examples include transcription termination sequences derived from genes with strong promoters, such as the trp gene in *E. coli* as well as other biosynthetic genes.

The expression vectors will have a plurality of restriction sites for insertion of the cell wall, cell surface or secreted protein sequence so that it is under transcriptional regulation of the regulatory regions. Selectable marker genes that ensure maintenance of the vector in the cell can also be included in the expression vector. Preferred selectable markers include those that confer resistance to drugs such as ampicillin, chloramphenicol, erythromycin, kanamycin (neomycin), and tetracycline (Davies et al. (1978) *Annu. Rev. Microbiol.* 32:469). Selectable markers may also allow a cell to grow on minimal medium, or in the presence of toxic metabolite and may include biosynthetic genes, such as those in the histidine, tryptophan, and leucine biosynthetic pathways.

The regulatory regions may be native (homologous), or may be foreign (heterologous) to the host cell and/or the nucleotide sequence of the invention. The regulatory regions may also be natural or synthetic. Where the region is "foreign" or "heterologous" to the host cell, it is intended that the region is not found in the native cell into which the region is introduced. Where the region is "foreign" or "heterologous" to the cell wall, cell surface or secreted protein nucleotide sequence of the invention, it is intended that the region is not the native or naturally occurring region for the operably linked cell wall, cell surface or secreted protein nucleotide sequence of the invention. For example, the region may be derived from phage. While it may be preferable to express the sequences using heterologous regulatory regions, native regions may be used. Such constructs would be expected in some cases to alter expression levels of cell wall, cell surface or secreted proteins in the host cell. Thus, the phenotype of the host cell could be altered.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

The invention further provides a recombinant expression vector comprising a DNA molecule of the invention cloned into the expression vector in an antisense orientation. That is, the DNA molecule is operably linked to a regulatory sequence in a manner that allows for expression (by transcription of the DNA molecule) of an RNA molecule that is antisense to a cell wall, cell surface or secreted protein mRNA. Regulatory sequences operably linked to a nucleic acid cloned in the antisense orientation can be chosen to direct the continuous or inducible expression of the antisense RNA molecule. The antisense expression vector can be in the form of a recombinant plasmid or phagemid in which antisense nucleic acids are produced under the control of a high efficiency regulatory region, the activity of which can be determined by the cell type into which the vector is introduced. For a discussion of the regulation of gene expression using antisense genes see Weintraub et al. (1986) *Reviews—Trends in Genetics*, Vol. 1(1).

Alternatively, some of the above-described components can be put together in transformation vectors. Transformation vectors are typically comprised of a selectable market that is either maintained in a replicon or developed into an integrating vector, as described above.

Microbial or Bacterial Host Cells

The production of bacteria containing the nucleic acid sequences or proteins designated, the preparation of starter cultures of such bacteria, and methods of fermenting substrates, particularly food substrates such as milk, may be carried out in accordance with known techniques.

By "introducing" as it pertains to nucleic acid molecules is intended introduction into prokaryotic cells via conventional transformation or transfection techniques, or by phage-mediated infection. As used herein, the terms "transformation," "transduction," "conjugation," and "protoplast fusion" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation. Suitable methods for transforming or transfecting host cells can be found in Sambrook et al. (1989) *Molecular Cloning: A Laboratory Manual* (2d ed., Cold Spring Harbor Laboratory Press, Plainview, N.Y.) and other laboratory manuals. By "introducing" as it pertains to polypeptides or microorganisms of the invention, is intended introduction into a host by ingestion, topical application, nasal, suppository, urogenital, or oral application of the polypeptide or microorganism.

Bacterial cells used to produce the cell wall, cell surface and secreted polypeptides of this invention are cultured in suitable media, as described generally in Sambrook et al. (1989) *Molecular Cloning, A Laboratory Manual* (2d ed., Cold Spring Harbor Laboratory Press, Plainview, N.Y.).

Function and Assays

Assays to measure binding activity of proteins such as periplasmic solute binding proteins (PFAM Accession PF01297) are well known in the art (see, for example, Hosie et al. (2001) *Mol. Microbiol.* 40: 1449-59; Hazlett et al. (2003) *J. Biol. Chem.* 278:20687-20694). Periplasmic solute binding proteins of the present invention include that in SEQ ID NO:2.

Glycosyl hydrolases, such as the O-Glycosyl hydrolases (EC 3.2.1.-) are a widespread group of enzymes that hydrolyse the glycosidic bond between two or more carbohydrates, or between a carbohydrate and a non-carbohydrate moiety. Glycosyl hydrolase family 32 (PFAM Accession PF00251) comprises enzymes with several known activities; invertase (EC:3.2.1.26); inulinase (EC:3.2.1.7); levanase (EC:3.2.1.65); exo-inulinase (EC:3.2.1.80); sucrose:sucrose 1-fructosyltransferase (EC:2.4.1.99); and fructan:fructan 1-fructosyltransferase (EC:2.4.1.100). Glycosyl hydrolase family 32 proteins of the present invention include that in SEQ ID NO:10.

Glycoside hydrolase family 31 (PFAM Accession PF01055) comprises enzymes with several known activities; -glucosidase (EC:3.2.1.20), -galactosidase (EC:3.2.1.22); glucoamylase (EC:3.2.1.3), sucrase-isomaltase (EC:3.2.1.48) (EC:3.2.1.10); -xylosidase (EC:3.2.1); -glucan lyase (EC:4.2.2.13). Glycosyl hydrolase family 31 proteins of the present invention include those in SEQ ID NOS:262, 264, and 268.

Assays to measure hydrolase activity are well known in the art (see, for example, Avigad and Bauer (1966) *Methods Enzymol.* 8:621-628; Neumann and Lampen (1967) *Biochemistry* 6:468-475; Henry and Darbyshire (1980) *Phytochemistry* 19:1017-1020).

Alpha amylase (PFAM Accession PF00128) is classified as family 13 of the glycosyl hydrolases. The structure of the alpha amylases consists of an 8 stranded alpha/beta barrel containing the active site, interrupted by an about 70 amino acid calcium-binding domain protruding between beta strand 3 and alpha helix 3, and a carboxyl-terminal Greek key beta-barrel domain. Assays to measure alpha-amylase activity are well known in the art (see, for example, Das et al. (2004) *Biotechnol. Appl. Biochem.* Mar 25; Grzybowska et al. (2004) *Mol. Biotechnol.* 26:101-110). Alpha amylase proteins of the present invention include those in SEQ ID NOS:260, 266, 270, 272, 274, 276, and 278.

Enzymes containing the Alpha amylase, N-terminal ig-like domain belong to family 13 of the glycosyl hydrolases (PFAM Accession PF02903). The maltogenic-amylase is an enzyme which catalyses hydrolysis of (1-4)-D-glucosidic linkages in polysaccharides so as to remove successive maltose residues from the non-reducing ends of the chains in the conversion of starch to maltose. Other enzymes include neopullulanase, which hydrolyses pullulan to panose, and cyclomaltodextrinase, which hydrolyses cyclodextrins. Alpha amylase, N-terminal ig-like domain proteins of the present invention include that in SEQ ID NO:274.

Enzymes containing the Isoamylase N-terminal domain belong to family 13 of the glycosyl hydrolases (PFAM Accession PF02922). This domain is found in a range of enzymes that act on branched substrates, ie. isoamylase, pullulanase and branching enzyme. Isoamylase hydrolyses 1,6-D-glucosidic branch linkages in glycogen, amylopectin and dextrin; 1,4-glucan branching enzyme functions in the formation of 1,6-glucosidic linkages of glycogen; and pullulanase is a starch-debranching enzyme. Isoamylase N-terminal domain proteins of the present invention include that in SEQ ID NO:272.

Surface layer proteins, which are glycoproteins forming a layer on the outermost cell envelope component of bacteria, may function as attachment structures for extracellular enzymes, or as cell shape determinants. Assays for measuring structure-function relationships of s-layer proteins are well known in the art (see, for example, Sleytr et al. (1997) *Trends Biotechnol.* 15:20-26; Olabarria et al. (1996) *J. Bacteriol.* 178:4765-4772). Surface layer proteins of the present invention include that in SEQ ID NO:62.

The N-acetylmuramoyl-L-alanine amidase family of proteins (PFAM Accession PF01510) includes zinc amidases that have N-acetylmuramoyl-L-alanine amidase activity (EC:3.5.1.28). This enzyme domain cleaves the amide bond between N-acetylmuramoyl and L-amino acids in bacterial cell walls (preferentially: D-lactyl-L-Ala). Methods to measure amidase activity are well known in the art (see, for example, Wang et al. (2003) *J. Biol. Chem.* 278:49044-52; Gelius et al. (2003) *Biochem Biophys Res Commun.* 306: 988-94). N-acetylmuramoyl-L-alanine amidase proteins of the present invention include that in SEQ ID NO:82.

Proteins such as FtsW, RodA, and SpoVE are integral membrane proteins involved in cell cycle processes (PFAM Accession PF01098). Methods to assay activity of cell cycle proteins are well known in the art (see, for example, Vinella et al. (1993) *J. Bacteriol.* 175:6704-6710). Cell cycle proteins of the present invention include those in SEQ ID NOS:92 and 286.

Mur ligase family proteins contain a number of related ligase enzymes which have EC numbers 6.3.2.-. This family includes: MurC, MurD, MurE, MurF, Mpl and FolC. MurC, MurD, MurE and MurF catalyse consecutive steps in the synthesis of peptidoglycan. Peptidoglycan consists of a sheet of two sugar derivatives, with one of these N-acetylmuramic acid attaching to a small pentapeptide. The pentapeptide is made of L-alanine, D-glutamic acid, Meso-diaminopimelic acid and D-alanyl alanine. The peptide moiety is synthesized by successively adding these amino acids to UDP-N-acetylmuramic acid. MurC transfers the L-alanine; MurD transfers the D-glutamate; MurE transfers the diaminopimelic acid; and MurF transfers the D-alanyl alanine. This family also includes Folylpolyglutamate synthase that transfers glutamate to folylpolyglutamate. Assays to measure ligase enzyme activity are well known in the art (see, for example, Bouhss et al. (1997) *Biochemistry*. 36:11556-11563; Hesse et al. (2003) *J. Bacteriol.* 185:6507-6512). Mur ligase family proteins of the present invention include those in SEQ ID NOS:94, 96, 98, 100, and 116.

Glycosyltransferases are enzymes that catalyse the transfer of sugar moieties from activated donor molecules to specific acceptor molecules, forming glycosidic bonds. The glycosyltransferase family 28 N-terminal domain (PFAM Accession PF03033) includes monogalactosyldiacylglycerol synthase (P93115, EC 2.4.1.46), 1,2-diacylglycerol 3-galactosyltransferase (EC:2.4.1.46), 1,2-diacylglycerol 3-glucosyltransferase (EC:2.4.1.157), and UDP-N-acetylglucosamine transferase (MURG_SYNY3, EC 2.4.1.-). The N-terminal domain contains the acceptor binding site and likely membrane association site. Glycosyltransferase family 28 N-terminal domain proteins of the present invention include that in SEQ ID NO:102.

The glycosyl transferases (PFAM Accession PF00953) are a family of UDP-GlcNAc/MurNAc:polyisoprenol-P GlcNAc/MurNAc-1-P transferases. Members of the family include eukaryotic N-acetylglucosamine-1-phosphate transferases, which catalyze the conversion of UDP-N-acteyl-D-glucosamine and dolichyl phosphate to UMP and N-acetyl-D-glucosaminyl-diphosphodolichol in the glycosylation pathway; and bacterial phospho-N-acetylmuramoyl-pentapeptide-transferases, which catalyze the first step of the lipid cycle reactions in the biosynthesis of cell wall peptidoglycan. Glycosyltransferase proteins (PFAM Accession PF00953) of the present invention include those in SEQ ID NOS:104 and 126.

The Glycosyl transferase family (PFAM Accession PF00535) is a diverse family of a variety of glycosyl transferases that transfer the sugar from UDP-glucose, UDP-N-acetyl-galactosamine, GDP-mannose or CDP-abequose, to a range of substrates including cellulose, dolichol phosphate and teichoic acids. Glycosyltransferase proteins (PFAM Accession PF00535) of the present invention include those in SEQ ID NOS:164, 170, 236, and 252.

Members of the Glycosyl transferases group 1 family (PFAM Accession PF00534) transfer activated sugars to a variety of substrates, including glycogen, fructose-6-phosphate and lipopolysaccharides. Members of this family transfer UDP, ADP, GDP or CMP linked sugars to a variety of substrates, including glycogen, fructose-6-phosphate and lipopolysaccharides. The bacterial enzymes are involved in various biosynthetic processes that include exopolysaccharide biosynthesis, lipopolysaccharide core biosynthesis and the biosynthesis of the slime polysaccaride colanic acid. Glycosyl transferases group 1 family proteins of the present invention include those in SEQ ID NOS:242, 250, and 258.

Assays to measure glycosyltransferase activity are well known in the art (see, for example, Mengin-Lecreulx et al. (1991) *J. Bacteriol.* 173:4625-4636).

The mannosyl-glycoprotein endo-beta-N-acetylglucosamidase family includes enzymes in EC:3.2.1.96, which cause endohydrolysis of the di-N-acetylchitobiosyl unit in high-mannose glycopeptides and glycoproteins containing the -[Man(GlcNAc)$_2$]Asn-structure. Assays to measure amidase activity are well known in the art (see, for example, Pierce et al. (1980) *Biochem. J.* 185:261-264; Koide and Muramatsu (1974) *J. Biol. Chem.* 249:4897-4904). Mannosyl-glycoprotein endo-beta-N-acetylglucosamidase proteins of the present invention include those in SEQ ID NOS:106 and 108.

The LysM domain is found in a variety of enzymes involved in bacterial cell wall degradation (Bateman and Bycroft (2000) *J. Mol. Biol.* 299:1113-1119). This domain may have a general peptidoglycan binding function. The structure of this domain is known (Joris et al. (1992) *FEMS Microbiol. Lett.* 70:257-264). LysM domain proteins of the present invention include that in SEQ ID NO:110.

The D-ala D-ala ligase N terminus family (PFAM Accession PF01820) includes D-alanine-D-alanine ligase (EC: 6.3.2.4), a bacterial enzyme involved in cell-wall biosynthesis. It participates in forming UDP-N-acetylmuramyl pentapeptide, the peptidoglycan precursor. These enzymes are proteins of 300 to 360 amino acids containing many conserved regions. The N-terminal Gly-rich region could be involved in ATP-binding. Methods for measuring D-alanine-D-alanine ligase activity are well known in the art (see, for example, Ito and Strominger (1962) *J. Biol. Chem.* 237: 2696-2703; Marshall et al. (1997) *Proc. Natl. Acad. Sci. U.S.A.* 94:6480-6483). D-ala D-ala ligase N terminus proteins of the present invention include that in SEQ ID NO:112).

D-alanyl-D-alanine carboxypeptidases (PFAM Accession PF00768) are serine peptidases belonging to Merops peptidase family S11 (D-Ala-D-Ala carboxypeptidase A family, clan SE). D-Ala-D-Ala carboxypeptidase A is involved in the metabolism of cell components. There are three families of serine-type D-Ala-D-Ala peptidase, which are also known as low molecular weight penicillin-binding proteins (S11, S12, S13). Family S11 contains only D-Ala-D-Ala peptidases, unlike families S12 and S13, which contain other enzymes, such as class C-lactamases and D-amino-peptidases (Rawlings and Barrett (1994) *Methods Enzymol.* 244: 19-61). Assays for measuring serine carboxypeptidase activity are well known in the art (see, for example, Chang et al. (1990) *Proc. Natl. Acad. Sci. U.S.A.* 87:2823-7). D-alanyl-D-alanine carboxypeptidase proteins of the present invention include that in SEQ ID NO:118.

EPSP synthase (3-phoshoshikimate 1-carboxyvinyl-transferase) (EC:2.5.1.19) catalyzes the sixth step in the biosynthesis from chorismate of the aromatic amino acids (the shikimate pathway) in bacteria (gene aroA), plants and fungi (where it is part of a multifunctional enzyme which catalyzes five consecutive steps in this pathway). The sequence of EPSP from various biological sources shows that the structure of the enzyme has been well conserved throughout evolution. Two strongly conserved regions are well defined. The first one corresponds to a region that is part of the active site and which is also important for the resistance to glyphosate. The second second one is located in the C-terminal part of the protein and contains a conserved lysine which seems to be important for the activity of the enzyme. Assays for measuring EPSP synthase activity are well known in the art (see, for example, Okunuki et al. (2003) *Shokuhin Eiseigaku Zasshi*. 44:77-82; Oliveira et al. (2001) *Protein Expr. Purif.* 22:430-435). EPSP synthase proteins of the present invention include that in SEQ ID NO:120.

The bacterial transferase hexapeptide (three repeats) family (PFAM Accession PF00132) contains a repeat structure composed of tandem repeats of a [LIV]-G-X(4) hexapeptide, which, in the tertiary structure of LpxA (UDP N-acetyl-glucosamine acyltransferase), has been shown to form a left-handed parallel helix (Raetz and Roderick (1995) *Science* 270:997-1000). Bacterial transferase hexapeptide proteins of the present invention include that in SEQ ID NO:122.

Members of the Putative undecaprenyl diphosphate synthase family (PFAM Accession PF01255) include Di-trans-poly-cis-decaprenylcistransferase (EC:2.5.1.31) (UPP synthetase), which generates undecaprenyl pyrophosphate (UPP) from isopentenyl pyrophosphate (IPP). Methods for measuring Upp synthetase activity are well known in the art (see, for example, Apfel et al. (1999) *J. Bacteriol.* 181:483-

492). Undecaprenyl diphosphate synthase proteins of the present invention include that in SEQ ID NO:124.

The penicillin-binding proteins are bifunctional proteins consisting of transglycosylase and transpeptidase in the N- and C-terminus respectively. The transglycosylase domain catalyses the polymerisation of murein glycan chains (Lefevre et al. (1997) *J. Bacteriol*. 179:4761-4767). Members of the Transglycosylase family (PFAM Accession PF00912) include the bifunctional penicillin-binding proteins that have a transglycosylase (N-terminus) and transpeptidase (C-terminus) domain and the monofunctional biosynthetic peptidoglycan transglycosylases. Methods to measure the catalytic activity of these proteins are well known in the art (see, for example, Di Guilmi et al. (2003) *J. Bacteriol*. 185:4418-4423). Penicillin-binding transglycosylase proteins of the present invention include those in SEQ ID NOS:134 and 138.

Members of the Penicillin binding protein transpeptidase domain family (PFAM Accession PF00905) have an active site serine (residue 337 in PBPX_STRPN) that is conserved in all members of the family. These proteins are responsible for the final stages of peptidoglycan biosynthesis for cell wall formation. The proteins synthesize cross-linked peptidoglycan from lipid intermediates, and contain a penicillin-sensitive transpeptidase carboxy-terminal domain. Assays for measuring transpeptidase activity are well known in the art (see, for example, Zijderveld et al. (1995) *J. Bacteriol*. 177:6290-6293). Penicillin-binding transpeptidase proteins of the present invention include those in SEQ ID NOS:132, 134, 138, and 146.

Members of the AMP-binding enzyme family (PFAM Accession PF00501) appear to act via an ATP-dependent covalent binding of AMP to their substrate, and share a region of sequence similarity. This region is a Ser/Thr/Gly-rich domain that is further characterised by a conserved Pro-Lys-Gly triplet. Assays for measuring the catalytic activity of these proteins are well known in the art (see, for example, Weimar et al. (2002) *J. Biol. Chem*. 277:29369-29376. AMP-binding proteins of the present invention include that in SEQ ID NO:148.

Many members of the Polysaccharide biosynthesis protein family (PFAM Accession PF01943) are implicated in production of polysaccharide. Assays for measuring polysaccharide biosynthesis are well known in the art (see, for example, Yao and Valvano (1994) *J. Bacteriol*. 176: 4133-4143). Polysaccharide biosynthesis proteins of the present invention include those in SEQ ID NOS:156 and 238.

Members of the UDP-galactopyranose mutase family (PFAM Accession PF03275) (EC:5.4.99.9) are involved in the conversion of UDP-GALP into UDP-GALF through a 2-keto intermediate, and contain FAD as a cofactor. Assays for measuring UDP-galactopyranose mutase activity are well known in the art (see, for example, Lee et al. (1996) *Anal. Biochem*. 242:1-7). UDP-galactopyranose mutase proteins of the present invention include that in SEQ ID NO:158.

The Bacterial sugar transferase family (PFAM Accession PF02397) represents a conserved region from a number of different bacterial sugar transferases, involved in diverse biosynthesis pathways. Examples include galactosyl-P—P-undecaprenol synthetase (EC:2.7.8.6), which transfers galatose-1-phosphate to the lipid precursor undecaprenol phosphate in the first steps of O-polysaccharide biosynthesis; UDP-galactose-lipid carrier transferase, which is involved in the biosynthesis of amylovoran; and galactosyl transferase CpsD, which is essential for assembly of the group B Streptococci (GBS) type III capsular polysaccharide. Methods for assaying for transferase activity are well known in the art (see, for example, Osborn and Yuan Tze-Yuen (1968) *J. Biol. Chem*. 243:5145-5152; Wright et al. (1967) *Proc. Natl. Acad. Sci*. USA 57:1798-1803). Bacterial sugar transferase proteins of the present invention include that in SEQ ID NO:174.

The Chain length determinant protein family (PFAM Accession PF02706) includes proteins involved in lipopolysaccharide (LSP) biosynthesis. Methods for measuring lipopolysaccharide biosynthesis are well known in the art (see, for example, Franco et al. (1998) *J. Bacteriol*. 180:2670-5). Chain length determinant proteins of the present invention include that in SEQ ID NO:180.

NlpC/P60 (PFAM Accession PF00877) is a family containing cell-wall peptidases, some members of which are known to hydrolyze D-gamma-glutamyl-meso-diaminopimelate or N-acetylmuramate-L-alanine linkages (Anantharaman and Aravind (2003) *Genome Biol*. 4:R11). NlpC/P60 proteins of the present invention include those in SEQ ID NOS:190, 194, and 196.

Ribonucleotide reductase (EC:1.17.4.1) provides the precursors necessary for DNA synthesis. This enzyme catalyzes the reductive synthesis of deoxyribonucleotides from their corresponding ribonucleotides: 2'-deoxyribonucleoside diphosphate+oxidized thioredoxin+$H_2O$=ribonucleoside diphosphate+reduced thioredoxin.

Ribonucleotide reductase is an oligomeric enzyme composed of a large subunit (700 to 1000 residues) and a small subunit (300 to 400 residues)—class II RNRs are less complex, using the small molecule B 12 in place of the small chain. The small chain binds two iron atoms (three Glu, one Asp, and two His are involved in metal binding) and contains an active site tyrosine radical. The regions of the sequence that contain the metal-binding residues and the active site tyrosine are conserved in ribonucleotide reductase small chain from prokaryotes, eukaryotes and viruses. Assays for measuring ribonucleoside-diphosphate reductase activity are well known in the art (see, for example, Nilsson et al. (1988) *Biochem. Soc. Trans*. 16:91-94; Reichard (1993) *Science* 260:1773-1777). Ribonucleotide reductase proteins of the present invention include that in SEQ ID NO:208.

ABC transporters (PFAM Accession PF00005) form a large family of proteins responsible for translocation of a variety of compounds across biological membranes. They are minimally composed of four domains, with two transmembrane domains (TMDs) responsible for allocrite binding and transport and two nucleotide-binding domains (NBDs) responsible for coupling the energy of ATP hydrolysis to conformational changes in the TMDs. Both NBDs are capable of ATP hydrolysis, and inhibition of hydrolysis at one NBD effectively abrogates hydrolysis at the other. The proteins belonging to this family also contain one or two copies of the 'A' consensus sequence (Walker et al. (1982) *EMBO J*. 1:945-951) or the 'P-loop' (Saraste et al. (1990) *Trends Biochem Sci*. 15:430-434). Methods for measuring ATP-binding and transport are well known in the art (see, for example, Hung et al. (1998) *Nature* 396:703-707; Higgins et al. (1990) *J. Bioenerg. Biomembr*. 22:571-592). ABC transporters proteins of the present invention include those in SEQ ID NOS:218 and 226.

Members of the UDP-N-acetylglucosamine 2-epimerase family (PFAM Accession PF02350) consist of UDP-N-acetylglucosamine 2-epimerases (EC:5.1.3.14). This enzyme catalyzes the production of UDP-ManNAc from UDP-GlcNAc. Assays to measure UDP-N-acetylglucosamine 2-epimerase activity are well known in the art (see, for example, Stasche et al. (1997) *J. Biol. Chem.* 272:24319-24324). UDP-N-acetylglucosamine 2-epimerase proteins of the present invention include those in SEQ ID NOS:244 and 246.

The tRNA (Guanine-1)-methyltransferase (PFAM Accession PF01746) family consists of tRNA (Guanine-1)-methyltransferases (EC:2.1.1.31). In *E. coli* K12 this enzyme catalyses the conversion of a guanosine residue to N1-methylguanine in position 37, next to the anticodon, in tRNA (Hjalmarsson et al. (1983) *J. Biol. Chem* 258:1343-1351. tRNA (guanine-N-1-)-methyltransferasecatalyses the reaction: S-adenosyl-L-methionine+tRNA->S-adenosyl-L-homocysteine+tRNA containing N1-methylguanine. In the process, guanosine(G) is methylated to N1-methylguanine (1-methylguanosine (m1G)) at position 37 of tRNAs that read CUN (leucine), CCN (proline), and CGG (arginine) codons. The presence of ml G improves the cellular growth rate and the polypeptide steptime and also prevents the tRNA from shifting the reading frame (Hagervall et al. (1990) *Biochim. Biophys. Acta.* 1050:263-266). Assays for measuring tRNA methyltransferase activity are well known in the art (see, for example, Hjalmarsson et al. (1983) *J. Biol. Chem.* 258:1343-1351). tRNA (Guanine-1)-methyltransferase proteins of the present invention include that in SEQ ID NO:294.

The aminoacyl-tRNA synthetases (EC:6.1.1) catalyse the attachment of an amino acid to its cognate transfer RNA molecule in a highly specific two-step reaction. The 20 aminoacyl-tRNA synthetases are divided into two classes, I and II (PFAM Accession PF00587). Class I aminoacyl-tRNA synthetases contain a characteristic Rossman fold and are mostly monomeric, while class II aminoacyl-tRNA synthetases share an anti-parallel-sheet formation, flanked by -helices (Perona et al. (1993) *Biochemistry* 32:8758-8771), and are mostly dimeric or multimeric. In reactions catalysed by the class I aminoacyl-tRNA synthetases, the aminoacyl group is coupled to the 2'-hydroxyl of the tRNA, while, in class II reactions, the 3'-hydroxyl site is preferred. The synthetases specific for arginine, cysteine, glutamic acid, glutamine, isoleucine, leucine, methionine, tyrosine, tryptophan and valine belong to class I synthetases. The synthetases specific for alanine, asparagine, aspartic acid, glycine, histidine, lysine, phenylalanine, proline, serine, and threonine belong to class-II synthetases. Assays to measure aminoacyl-tRNA synthetases activity are well known in the art (see, for example, Augustine and Francklyn (1997) *Biochemistry* 36:3473-3482). Aminoacyl-tRNA synthetase proteins of the present invention include that in SEQ ID NO:296.

The LuxS protein family (LuxS) (PFAM Accession PF02664) consists of the LuxS protein involved in autoinducer A12 synthesis and its hypothetical relatives. In bacteria, the regulation of gene expression in response to changes in cell density is called quorum sensing. Quorum-sensing bacteria produce, release, and respond to hormone-like molecules (autoinducers) that accumulate in the external environment as the cell population grows. The LuxS protein is involved in quorum sensing and is a autoinducer-production protein (Surette et al. (1999) *Proc. Natl. Acad. Sci.* USA. 96:1639-1644). Methods to detect quorum sensing are well known in the art (see, for example, Surette et al. (1999) *Proc. Natl. Acad. Sci.* U.S.A. 96:1639-1644). LuxS proteins of the present invention include that in SEQ ID NO:304.

Methods of Use

In one embodiment, polypeptides of the present invention, as well as microbes expressing them may alter the immune system of a host, including alteration of the humoral, cellular, and nonspecific immune responses, both locally and systemically. Immune system alteration by probiotic bacteria may occur, for example, by augmentation of non-specific or antigen-specific defenses against infection and tumors, by increased mucosal immunity, by providing an adjuvant effect in an antigen-specific immune response, or by regulation of Th1/Th2 cells and their cytokine production (See, for example, U.S. Application No. 2002/0159976). By "adjuvant" is intended a substance that increases the immune response to an antigen when introduced together with the antigen.

Humoral immunity may be augmented by increased IgA production and stimulation of B lymphocyte production after consumption of probiotic bacteria. Methods used to study the mucosal immune system, including assays to measure the type and concentration of immunoglobulins and assays to assess the number and type of immune cells, are well known in the art (see, for example; Erickson and Hubbard (2000) *J. Nutr.* 130:403S-409S). Modification of non-specific immunity may result in altered production of cytokines such as IL-1β, IL-6, IL-10, TNFα, IL-12, IFN-γ, and IL-18, and enhanced phagocytic activity; assays to detect the type and amount of cytokines released from cells after stimulation with probiotic bacteria, and other assays to measure non-specific immunity are known in the art (see, for example, Miettinen et al. (1996) *Infect. Immun.* 64:5403-5405; Marin et al. (1998) *J. Food Prot.* 61:859-864; Schiffrin et al. (1994) *J. Dairy Sci.* 78:491-497). Alteration of cellular immunity may result in the increased production of macrophages, or altered cytokine production. Proteases from probiotic supplements can degrade the casein in cow milk, generating peptides that suppress lymphocyte proliferation (Sutas et al. (1996) *J. Allergy Clin. Immunol.* 98:216-224). Assays to measure the cellular immune response, such as lymphocyte proliferation assays, are well known in the art (see, for example, Erickson and Hubbard (2000) *J. Nutr.* 130:403S-409S; De Simone et al. (1993) *J. Immunother.* 9:23-28); Perdigón et al. (1986) *Infect. Immun.* 53:404-410).

Probiotic bacteria may also enhance the immune response to oral vaccines (see Chin et al. (2000) *Immunol. Cell Biol.* 78:55-66; Isolauri et al. (1995) *Vaccine* 13:310-312), have anti-inflammatory properties (Pessi et al. (1999) *Appl. Environ. Microbiol.* 65:475-478; Isolauri et al. (2001) *Am. J. Clin. Nutr.* 73:444S-450S; Antonopoulou et al. (1996) *J. Agric. Food Chem.* 44:3047-3051), and stabilize intestinal permeability to macromolecules (Heyman (2000) *J. Am. College Nutr.* 19:137S-146S; Isolauri et al. (1993) *Ped. Res.* 33:548-553). This effect on intestinal permeability may result from the maintenance or repair of tight junctions between the mucosal epithelial cells. Assays to measure these properties are known in the art, and examples can be found in the references cited.

In another embodiment, polypeptides of the present invention as well as microbes expressing them may alter the expression of various host proteins or compounds. These proteins and compounds include, but are not limited to, cell surface proteins (i.e. cell adhesion molecules), proteins involved in mucin production (i.e., MUC1 and MUC2), cell signaling proteins (i.e., tyrosine kinases, protein kinase C, mitogen-activated protein kinases, and nuclear factor kappa B (NF-κB)), proteins involved in host tolerance of commensal bacteria, and antimicrobial proteins or compounds (i.e., hydrogen peroxide (Hawes et al. (1996) *J. Infect. Dis*

174:1058-1063) or nitric oxide (Korhonen et al. (2002) *Inflammation* 26:207-214)). By "cell surface" as it relates to an altered host protein is intended a protein found in association with a cell membrane. By "mucin" is intended a protein secreted by mucous glands or mucous cells. By "cell signaling protein" is intended a protein involved in cell signaling. By "host tolerance" is intended the decrease in, or loss of, the ability of an animal to produce an immune response upon the administration of a particular antigen. By "commensal bacteria" is intended a bacterium that exists in close physical association with another organism, where neither organism benefits nor is harmed as a result of the association. By "antimicrobial" is intended a compound that prevents the growth of or kills a microorganism.

Altered expression of cell adhesion molecules, or regions/domains/fragments thereof, may enable a microorganism to have modified adherence properties. Alternatively, proteins involved in mucin production may prevent the ability of pathogenic organisms to attach to intestinal epithelial cells (Mack et al. (1999) *Am. J. Physiol.* 276:G941-G950). The composition, quality and quantity of mucin production could be affected, leading to altered pathogen-mucin interactions. Assays to measure altered expression of host proteins or compounds are well known in the art, and include Northern blots and Western blots. See, for example, Sambrook et al. (1989) *Molecular Cloning: A Laboratory Manual* (Cold Spring Harbor Laboratory Press, Plainview, N.Y.).

In yet another embodiment, the polypeptides and microorganisms expressing them may be useful for the treatment or prevention of gastrointestinal disorders, including, but not limited to, inflammatory bowel disease, Crohn's disease, ulcerative colitis, irritable bowel syndrome, diarrhea, antibiotic associated diarrhea, constipation, and small bowel bacterial overgrowth. By "treatment or prevention" is intended a reduction in or prevention of any of the symptoms associated with a disease that occurs following administration of a polypeptide or microorganism of the present invention. This reduction includes any decrease in intensity or duration of symptoms in the subject receiving therapy. As used herein, an "effective amount" of a polypeptide or microorganism of the present invention will be sufficient to prevent, reduce, or lessen the clinical symptoms of the disease being treated.

Probiotic bacteria may be effective in treating or preventing gastrointestinal disorders by acting as an immunomodulator, as mentioned above, by influencing the gut-associated lymphoid tissue, or may attach to the epithelium forming a protective layer, preventing invasion by pathogenic bacteria (Kasper (1998) *Int. J. Food Micro.* 41:127 131). Probiotic bacteria have been administered to patients with Crohn's disease, a chronic inflammatory bowel disease, with resultant immunological improvement (Malin et al. (1996) *Ann. Nutr. Metab.* 40:137-145). Positive effects have also been seen when treating constipation (Kasper (1998) *Int. J. Food Micro.* 41:127-131), enteric *rotavirus*-associated infection in children (Isolauri et al. (1991) *Pediatrics* 88:90-97; Boudraa et al. (1990) *Gastroenterol. Nutr.* 11:509-512), travelers' diarrhea (Hilton et al. (1997) *J. Travel Med.* 4:41-43), small bowel bacterial overgrowth (Vanderhoof et al. (1998) *J. Pediatr. Gastroenterol. Nutr.* 27:155-160), and antibiotic associated diarrhea (Biller et al. (1995) *J. Pediatr. Gastr. Nutr.* 21:224-226). Assays to determine the clinical effectiveness of using probiotic bacteria to treat or prevent a gastrointestinal disorder are known in the art (see, for example, Guandalini et al. (2000) *J. Pediatr. Gastroenterol. Nutr.* 30:54-60; Saavedra et al. (1994) *Lancet* 344:1046-1049).

In yet another embodiment, a polypeptide or a microorganism expressing a polypeptide of the current invention may prevent or reduce the occurrence of an infection in a host. By "reduce the occurrence of" is intended a reduction in the probability of a subject becoming infected with an organism and subsequently exhibiting symptoms of a disease caused by that organism. Infections that can be prevented or treated by probiotic bacteria include, but are not limited to, those caused by a food-borne pathogen (i.e., enterotoxigenic *Escherichia coli* (ETEC), *Salmonella typhimurium, Listeria monocytogenes,* and *Vibrio cholerae*) (see Boris et al. (1998) *Infect. Immun.* 66:1985-1989; Silva et al. (2001) *J. Med. Microbiol.* 50:161-164; Strus et al. (2001) *Med. Dosw. Mikrobiol.* 53:133-142; Tannock (1999) Probiotics: a critical review. Horizon Scientific Press, 161 pp; Salminen, S, and von Wright, A. 1998. Lactic acid bacteria: microbiology and functional aspects. Marcel Dekker, Inc. NY. 617pp.), infections caused by an opportunistic pathogen, infections caused by *Helicobacter pylori* (Cremonini et al. (2001) *Dig. Dis.* 19:144-147; Lorca et al. (2001) *Current Micro.* 42:39-44), urogenital diseases such as vaginosis or vaginitis (Reid et al. (2001) *FEMS Immunol. Med. Micro.* 30:49-52), and HIV infection (Hashemi et al. (2000) *J. Infect. Dis.* 181:1574-1580). Methods to determine whether probiotic bacteria are effective at treating or preventing infections are well known in the art, and examples may be found in the above references.

In another embodiment, the polypeptides may enable a microorganism to bind and remove detrimental compounds in the gastrointestinal tract, including toxins, mutagens, bile salts, fats, cholesterol, and currently unidentified proteins or compounds. The compounds may also be inactivated, sequestered, degraded, digested, cleaved or modified. The compounds may be produced by the host, for instance as a result of the digestion of a food product with mutagenic compounds (i.e., heterocyclic amines formed during the cooking of meat), or may be produced by microorganisms that are present in the gastrointestinal tract (i.e., microbial metabolites that possess genotoxic, mutagenic or carcinogenic activity). Bacterial enzymes such as NAD(P)H dehydrogenase (azoreductase), nitroreductase, β-glucoronidase, β-glucosidase, and 7-α-dehydroxylase may increase the carcinogenic effect of toxic compounds. Bacteria such as *lactobacilli* have lower activities of these xenobiotic-metabolizing enzymes, and administration of some strains decreased the activity of nitroreductase and β-glucoronidase (Goldin and Gorbach (1984) *Am. J. Clin. Nutr.* 39:756-761; Goldin et al. (1992) *Dig. Dis. Sci.* 37:121-128; Benno and Mitsuoka (1992) *Microbiol. Immunol.* 36:683-694; Bouhnik et al. (1996) *Eur. J. Clin. Nutr.* 50:269-273).

The polypeptides themselves may also possess these activities. Thus, the proteins of the invention or probiotic bacteria expressing them may find use in the treatment or prevention of cancer, particularly colon cancer. Anticarcinogenic effects of probiotic bacteria have been noted (Wollowski et al. (2001) *Am. J. Clin. Nutr.* 73:451 S-455S; Hayatsu and Hayatsu (1993) *Cancer Lett.* 73:173-179), and the physical binding of various mutagenic compounds to lactic acid bacteria has been shown (Orrhage et al. (1994) *Mutation Res.* 311:239-248). Assays to measure various anticarcinogenic effects of probiotic bacteria are well known in the art (see, for example, Wollowski et al. (2001) *Am. J. Clin. Nutr.* 73:451S-455S; Goldin and Gorbach (1980) *J. Natl. Cancer Inst.* 64:263-265; Goldin and Gorbach (1984) *J. Natl. Cancer Inst.* 73:689-695).

In addition to cancer prevention, polypeptides of the invention or microorganisms expressing them may lower serum cholesterol levels and aid in the prevention of heart disease. Lactic acid bacteria can remove cholesterol from culture medium (Klayer and van der Meer (1993) *Appl. Environ. Microbiol.* 59:1120-1124) and some studies have shown a decrease in serum cholesterol in humans after consumption of probiotic bacteria (Lin et al. (1989) *J Dairy Res.* 72:2885-2899; Khedkar et al. (1993) *J. Dairy Foods Home Sci.* 12:33-38). Cholesterol levels may be lowered by probiotic bacteria through the deconjugation of bile acids, since cholesterol is converted to bile acids to replace those lost by excretion (Sanders (2000) *J. Nutr.* 130:384S-390S).

In another embodiment, a polypeptide of the present invention, or a variant thereof, may enhance the stability of a microorganism. This enhanced stability may enable a microorganism to survive passage through the stomach, small intestine and/or gastrointestinal tract, to resist acid and bile in those areas, or to persist in the gastrointestinal tract after ingestion by a host. Enhanced stability might also allow the microorganism to withstand stressful conditions that occur during production and processing of a fermented product, including storage of the microorganism. These stresses include, but are not limited to, oxidative stress, pH, pressure, osmotic stress, dehydration, carbon starvation, phosphate starvation, nitrogen starvation, amino acid starvation, mechanical manipulation such as centrifugation, heat or cold shock, mutagenic stress, and the stresses associated with various storage conditions, including cell culture, freezing, lyophilization, and drying (see Girgis et al. (2002) Stress adaptations of lactic acid bacteria. In *Microbial adaptation to stress and safety of new-generation foods.* Yousef, A. E. and Juneja, V. K. (Eds.) Technomic Publishing Co. Inc.). A polypeptide of the invention could provide protection against one or more stresses. Assays to measure the stability of microorganisms are well known in the art (for example, Klaenhammer and Kleeman (1981) *Appl. Environ. Microbiol.* 41:1461-1467; Wright and Klaenhammer (1983) *J. Food Sci.* 48:773-777). Sequences that may be useful in enhancing stability include, but are not limited to, those set forth in SEQ ID NOS:60, 62, 286, 270, 294, 300, 302, 304 and 306.

In another embodiment, a polypeptide of the current invention, or a variant thereof, may enable a microorganism to have modified adherence properties. These adherence properties could allow the microorganism to bind with an increased or decreased ability to a specific cell type, such as an intestinal epithelial cell or to another bacterial cell, or to a compound, such as a mucin (see, for example, Ouwehand et al. (2000) *Lett. Appl. Microbiol.* 30:10-13; Tuomola et al. (1999) *FEMS Immunol. Med. Microbiol.* 26:137-142). An increased ability to adhere to other bacterial cells may result in aggregation. Assays to measure bacterial adhesion are well known in the art (see, for example, Jin et al. (2000) *Appl. Environ. Microbiol.* 66:4200-4204; Coconnier et al. (1992) *Appl. Environ. Microbiol.* 58:2034-2039; Greene and Klaenhammer (1994) *Appl. Environ. Microbiol.* 60:4487-4494; Lorca et al. (2002) *FEMS Microbiol Lett* 206:31-37; Antikainen et al. (2002) *Mol. Microbiol.* 46:381-94).

In another embodiment, a polypeptide of the invention may enable a microorganism to reduce the occurrence of dental caries after oral administration to a subject. Methods to assess the ability of probiotic bacteria to reduce dental caries are known in the art (see, for example, Nase et al. (2001) *Caries Res.* 35:412-420).

In another embodiment, a polypeptide of the invention may enable a microorganism to increase feed conversion in a production animal. Methods of measuring increased feed conversion in a production animal are known in the art (see, for example, Fuller (1998) Priobiotics for farm animals. In: Probiotics: A Critical Review (Tannock, G. W., ed.). Horizon Scientific Press, Wymondham, UK.

In another embodiment, the polynucleotides and polypeptides of the invention may enable a microorganism to antagonize or kill another microorganism, including a pathogen. By "antagonizing" is intended an interaction between two biologically active substances, such that one partially or completely inhibits an activity of the other. The polypeptides may enable a microorganism expressing them to bind to another microorganism, to have antimicrobial activity towards another microorganism, or to lyse another microorganism. Expression of the polypeptide may result in the first microorganism competing with the second microorganism for essential binding sites or essential nutrients, for example in the gastrointestinal tract of a host that has ingested the microorganism (see, for example, Jin et al. (2000) *Appl. Environ. Microbiol.* 66:4200-4204). In different embodiments, isolated polypeptides themselves may antagonize or kill microorganisms, by the same mechanisms as mentioned above. Assays to measure antimicrobial activity, including the lysis or death of a microorganism are known in the art (see Methods for General and Molecular Bacteriology. 1994. Gerhardt, P., Murray, R. G. E., Wood, W. A. Krieg, N. R. (Eds.) American Society for Microbiology, 791 pp.). Assays to measure bacterial adhesion are well known in the art (see, for example, Jin et al., above). Assays to measure competition for binding sites or nutrients are known in the art (see, for example, Edelman et al. (2003) *Vet. Microbiol.* 91:41-56; Gan et al. (2002) *J. Infect. Dis.* 185:1369-1372; Horie et al. (2002) *J. Appl. Microbiol.* 92:396-403).

In another embodiment, the polypeptides may have antimicrobial activity and provide use in various applications, including food protection and wound treatment, such as for a topical treatment. Methods for detecting antimicrobial activity in a protein are well known in the art (Allison and Klaenhammer (1999) Genetics of bacteriocins produced by lactic acid bacteria and their use in novel industrial applications. pp789-808. In *Manual of Industrial Microbiology and Biotechnology.* A. L. DeMain and J. E. Davies. (eds.) ASM Press, Washington, D.C.).

In another embodiment, the polypeptides of the invention may modulate the antibiotic sensitivity of a microorganism, or the polypeptides may modulate the sensitivity of a microorganism to other compounds with antimicrobial activity. Methods for detecting the antibiotic sensitivity of a microorganism or the sensitivity of a microorganism to a compound with antimicrobial activity are well known in the art.

In another embodiment, a polypeptide may enable a microorganism to aggregate or form a biofilm, or enable a first microorganism to interfere with a second microorganisms' ability to form a biofilm. The polypeptides themselves may also interfere with a microorganisms' ability to form a biofilm. By "biofilm" is intended a microbially derived sessile community characterized by cells that are irreversibly attached to a substratum or interface or to each other, are embedded in a matrix of extracellular polymeric substances that they have produced, and exhibit an altered phenotype with respect to growth rate and gene transcription. Assays to measure biofilm formation are well known in the art (see, for example, O'Toole and Kolter (1998) *Mol. Microbiol.* 28:449-461; Yoshida and Kuramitsu (2002) *Appl Environ Microbiol* 68:6283-6291).

In another embodiment, a sorting signal sufficient for cell wall anchoring isolated from a polypeptide of the present invention may be fused to a heterologous protein (Schneewind et al. (1993) *EMBO J.* 12:4803-4811; Schneewind et al. (1992) *Cell* 70:267-281). The LPXTG (SEQ ID NO:308) motif has been identified as characteristic of surface proteins in Gram-positive bacteria (Navarre and Schneewind (1994) *Molecular Microbiology* 14:115-121; Fischetti et al. (1990) *Mol. Microbiol.* 4:1603-1605). Assays to measure expression of heterologous proteins on the surface of a cell are well known in the art (see, for example, Steidler et al. (1998) *Appl. Env. Micro.* 64:342-345).

The polypeptides of the invention may modulate the texture or other physical properties of a food product produced using a lactic acid bacteria. Exopolysaccharides may act as stabilizers, thickeners, gelling agents, viscosifying agents, and emulsifiers in various food products (De Vuyst and Degeest (1999) FEMS Microbiol. Rev. 153-177). The increased viscosity of foods containing exopolysaccharides may be beneficial for probiotic bacterial colonization in the gastrointestinal tract (German et al. (1999) *Trends Biotechnol.* 17:491-499; Jolly et al. (2002) *Antonie van Leeuwenhoek* 82:367-374). Methods for measuring texture of a food product are known in the art (see, for example, van den Berg et al. (1995) *Appl. Envir. Microbiol.* 61:2840-2844).

TABLE 1

| SEQ ID NO: | IDENTITY/FUNCTION |
|---|---|
| 1, 2 | ABC-type metal ion transport system, periplasmic component/surface adhesin |
| 3, 4 | lemA protein |
| 5, 6 | FmtB surface protein |
| 7, 8 | 67 kDa Myosin-crossreactive streptococcal antigen |
| 9, 10 | Myosin-crossreactive antigen |
| 11, 12 | Sortase |
| 13, 14 | Mucus binding protein precursor |
| 15, 16 | Mucus binding protein precursor |
| 17, 18 | Mucus binding protein precursor (Mub) |
| 19, 20 | Mucus binding protein precursor (Mub) |
| 21, 22 | Mucus binding protein precursor (Mub) |
| 23, 24 | Mucus binding protein precursor |
| 25, 26 | Mucus binding protein |
| 27, 28 | Mucus binding protein |
| 29, 30 | Mucus binding protein |
| 31, 32 | Mucus binding protein |
| 33, 34 | Mucus binding protein |
| 35, 36 | Mucus binding protein precursor |
| 37, 38 | Mucus binding protein precursor |
| 39, 40 | Steroid binding protein |
| 41, 42 | Surface exclusion protein |
| 43, 44 | Tropomyosin-like protein |
| 45, 46 | Biofilm-associated surface protein |
| 47, 48 | Aggregation promoting protein |
| 49, 50 | Aggregation promoting protein |
| 51, 52 | Fibrinogen-binding protein |
| 53, 54 | Fibrinogen-binding protein |
| 55, 56 | Fibrinogen-binding protein |
| 57, 58 | Fibronectin-binding protein |
| 59, 60 | Surface layer protein |
| 61, 62 | Surface layer protein |
| 63, 64 | Surface layer Protein |
| 65, 66 | Surface layer protein |
| 67, 68 | Surface layer protein |
| 69, 70 | Surface layer protein |
| 71, 72 | Surface layer protein |
| 73, 74 | Surface layer protein |
| 75, 76 | Surface protein |
| 77, 78 | Surface protein |
| 79, 80 | Surface protein |
| 81, 82 | Autolysin; amidase |
| 83, 84 | Cell shape-determining protein (MreB) |
| 85, 86 | Cell shape-determining protein (MreB) |
| 87, 88 | Cell shape-determining protein (MreC) |
| 89, 90 | Cell shape-determining protein (MreD) |
| 91, 92 | Rod shape-determining protein (RodA) |
| 93, 94 | UDP-N-acetylmuramate-alanine ligase |

TABLE 1-continued

| SEQ ID NO: | IDENTITY/FUNCTION |
|---|---|
| 95, 96 | UDP-N-acetylmuramyl tripeptide synthetase |
| 97, 98 | UDP-N-acetylmuramoyl-L-alanyl-D-glutamyl-lysine ligase |
| 99, 100 | UDP-N-acetylmuramoylalanine-D-glutamate ligase |
| 101, 102 | p-N-acetylmuramoyl-pentapeptide-transferase |
| 103, 104 | p-N-acetylmuramoyl-pentapeptide-transferase |
| 105, 106 | N-acetylmuramidase |
| 107, 108 | N-acetylmuramidase |
| 109, 110 | N-acetylmuramidase |
| 111, 112 | d-alanine-d-alanine ligase |
| 113, 114 | Permease |
| 115, 116 | d-ala-d-ala adding enzyme |
| 117, 118 | d-alanyl-d-alanine carboxypeptidase |
| 119, 120 | UDP-N-acetylglucosamine 1-carboxyvinyltransferase |
| 121, 122 | UDP-N-acetylglucosamine pyrophosphorylase |
| 123, 124 | Undecaprenyl pyrophosphate synthetase |
| 125, 126 | Undecaprenyl-phosphate N-acetyl-glucosaminyltransferase |
| 127, 128 | Penicillin binding protein |
| 129, 130 | Penicillin binding protein |
| 131, 132 | Penicillin binding protein |
| 133, 134 | Penicillin binding protein |
| 135, 136 | Penicillin binding protein |
| 137, 138 | Penicillin binding protein 1A |
| 139, 140 | Penicillin binding protein-related factor A |
| 141, 142 | Penicillin binding protein |
| 143, 144 | Penicillin binding protein |
| 145, 146 | Penicillin binding protein 2B |
| 147, 148 | DltA D-alanine-D-alanyl carrier protein ligase |
| 149, 150 | DltB basic membrane protein |
| 151, 152 | DltC D-alanyl carrier protein |
| 153, 154 | DltD extramembranal transfer protein |
| 155, 156 | Oligosaccharide repeat unit transporter (EpsI) |
| 157, 158 | UDP-galactopyranose mutase |
| 159, 160 | UDP-galactopyranose mutase |
| 161, 162 | Polysaccharide polymerase |
| 163, 164 | Glycosyltransferase |
| 165, 166 | Cell surface, cell membrane or secreted protein |
| 167, 168 | Cell surface, cell membrane or secreted protein |
| 169, 170 | Glycosyltransferase |
| 171, 172 | Galactosyl transferase |
| 173, 174 | Phospho-glucosyltransferase (EpsE) |
| 175, 176 | EpsD |
| 177, 178 | EpsC |
| 179, 180 | EpsB |
| 181, 182 | EpsA |
| 183, 184 | GTP-binding protein |
| 185, 186 | Cell surface, cell membrane or secreted protein |
| 187, 188 | Cell surface protein |
| 189, 190 | Cell wall-associated hydrolase |
| 191, 192 | Cell surface, cell membrane or secreted protein |
| 193, 194 | Cell wall-associated hydrolase |
| 195, 196 | Glycosidase |
| 197, 198 | Guanylate kinase |
| 199, 200 | Cell surface, cell membrane or secreted protein |
| 201, 202 | Membrane protein |
| 203, 204 | Cell surface, cell membrane or secreted protein |
| 205, 206 | Ribonucleotide reductase (NrdI) |
| 207, 208 | Ribonucleotide reductase |
| 209, 210 | Cell surface, cell membrane or secreted protein |
| 211, 212 | Cell surface, cell membrane or secreted protein |
| 213, 214 | Cell surface, cell membrane or secreted protein |
| 215, 216 | ABC transporter component |
| 217, 218 | ABC transporter |
| 219, 220 | Cell surface, cell membrane or secreted protein |
| 221, 222 | Membrane protein |
| 223, 224 | Membrane protein |
| 225, 226 | ATPase component of ABC transporter |
| 227, 228 | Cell surface, cell membrane or secreted protein |
| 229, 230 | Acetyltransferase |
| 231, 232 | Transcriptional regulator |
| 233, 234 | Polysaccharide transporter |
| 235, 236 | EpsV |
| 237, 238 | EpsU |
| 239, 240 | EpsA |
| 241, 242 | Capsular polysaccharide biosynthesis protein J (capJ) |
| 243, 244 | Cap5P |
| 245, 246 | Cap5P |
| 247, 248 | CpsIVN |

TABLE 1-continued

| SEQ ID NO: | IDENTITY/FUNCTION |
|---|---|
| 249, 250 | Lipopolysaccharide biosynthesis protein |
| 251, 252 | Cellulose synthase |
| 253, 254 | Sucrose phosphorylase |
| 255, 256 | Polysaccharide transporter |
| 257, 258 | LPS biosynthesis protein |
| 259, 260 | Oligo-1,6-glucosidase |
| 261, 262 | Alpha-glucosidase |
| 263, 264 | Alpha-glucosidase |
| 265, 266 | Glucan 1,6-alpha-glucosidase |
| 267, 268 | Alpha-glucosidase II |
| 269, 270 | Dextran glucosidase |
| 271, 272 | 1,4-alpha-glucan branching enzyme |
| 273, 274 | Neopullulanase |
| 275, 276 | Pullulanase |
| 277, 278 | Amylopullulanase |
| 279, 280 | Cyclomaltodextrin transport membrane protein |
| 281, 282 | Cell surface, cell membrane or secreted protein |
| 283, 284 | Cell surface protein |
| 285, 286 | Cell surface protein (bacterial cell division membrane protein) |
| 287, 288 | Membrane protein |
| 289, 290 | Membrane protein |
| 291, 292 | DNA methylase |
| 293, 294 | tRNA (guanine-N1)-methyltransferase |
| 295, 296 | Theronyl-tRNA synthetase |
| 297, 298 | Surface protein |
| 299, 300 | Transport accessory protein |
| 301, 302 | Methionine synthase |
| 303, 304 | Autoinducer-2 production protein (LuxS) |
| 305, 306 | Cell division protein (cdpA) |
| 307 | Biofilm-associated surface protein |

The following examples are offered by way of illustration and not by way of limitation.

EXAMPLE 1

Gapped BlastP Results for Amino Acid Sequences

A Gapped BlastP amino acid sequence alignment showed that SEQ ID NO:2 (306 amino acids) has about 73% identity from amino acids 7-304 with a protein from *Lactobacillus gasseri* that is a ABC-type metal ion transport system, periplasmic component/surface adhesin (Accession No. ZP_00046648.1), about 71% identity from amino acids 9-304 with a protein from *Lactobacillus johnsonii* that is an ABC transporter solute-binding component (Accession No. NP_965678.1), about 62% identity from amino acids 18-306 with a protein from *Lactobacillus gasseri* that is an ABC-type metal ion transport system, periplasmic component/surface adhesin (Accession No. ZP_00046208.1), about 62% identity from amino acids 26-306 with a hypothetical protein from *Lactobacillus johnsonii* (Accession No. NP_964756.1), and about 45% identity from amino acids 18-306 with a protein from *Leuconostoc mesenteroides* subsp. *mesenteroides* that is an ABC-type metal ion transport system, periplasmic component/surface adhesin (Accession No. ZP_00064315.1).

A Gapped BlastP amino acid sequence alignment showed that SEQ ID NO:4 (191 amino acids) has about 75% identity from amino acids 29-191 with an uncharacterized conserved protein from *Lactobacillus gasseri* (Accession No. ZP_00047066.1), about 76% identity from amino acids 29-191 with a protein from *Lactobacillus johnsonii* that is a LemA-like protein (Accession No. NP_964093.1), about 68% identity from amino acids 29-191 with an unknown protein from *Lactobacillus plantarum* (Accession No. NP_784295.1), about 65% identity from amino acids 29-191 with a protein from *Streptococcus mutans* that is a LemA-like protein (Accession No. NP_722235.1), and about 61% identity from amino acids 29-191 with a protein from *Streptococcus pneumoniae* that is a lemA protein (Accession No. NP_345748.1).

A Gapped BlastP amino acid sequence alignment showed that SEQ ID NO:6 (2539 amino acids) has about 41% identity from amino acids 1-2501 with a hypothetical protein from *Lactobacillus johnsonii* (Accession No. NP_964984.1), about 27% identity from amino acids 797-2209 with a protein from *Abiotrophia defectiva* that is an extracellular matrix binding protein (Accession No. pir||T31110), about 20% identity from amino acids 4-2521 with a protein from *Staphylococcus epidermidis* that is a FmtB protein (Accession No. NP_764984.1), about 21% identity from amino acids 1-2529 with a protein from *Staphylococcus aureus* subsp. *aureus* that is homologous to a streptococcal adhesin emb (Accession No. NP_374548.1), and about 20% identity from amino acids 1-2529 with a hypothetical protein from *Staphylococcus aureus* subsp. *aureus* (Accession No. NP_371958.1).

A Gapped BlastP amino acid sequence alignment showed that SEQ ID NO:8 (591 amino acids) has about 84% identity from amino acids 1-591 with a protein from *Lactobacillus gasseri* that is a myosin-crossreactive antigen (Accession No. ZP_00047333.1), about 83% identity from amino acids 1-591 with a hypothetical protein from *Lactobacillus johnsonii* (Accession No. NP_964681.1), about 70% identity from amino acids 1-591 with a protein from *Leuconostoc mesenteroides* subsp. *mesenteroides* that is a myosin-crossreactive antigen (Accession No. ZP_00063735.1), about 67% identity from amino acids 1-591 with a protein from *Streptococcus pyogenes* that is a 67 kDa myosin-crossreactive streptococcal antigen (Accession No. NP_268761.1), and about 67% identity from amino acids 1-591 with a protein from *Streptococcus pyogenes* that is a 67 kDa myosin-crossreactive *streptococcal* antigen (Accession No. NP_664136.1).

A Gapped BlastP amino acid sequence alignment showed that SEQ ID NO:10 (590 amino acids) has about 79% identity from amino acids 1-590 with a protein from *Lactobacillus gasseri* that is a myosin-crossreactive antigen (Accession No. ZP_00046024.1), about 71% identity from amino acids 1-590 with a protein from *Streptococcus mutans* that is homologous to a 67 kDa myosin-crossreactive streptococcal antigen (Accession No. NP_721921.1), about 60% identity from amino acids 1-590 with a protein from *Staphylococcus aureus* subsp. *aureus* that is homologous to a 67 kDa myosin-crossreactive *streptococcal* antigen (Accession No. NP_644896.1), about 59% identity from amino acids 1-590 with a protein from *Staphylococcus aureus* subsp. *aureus* that is homologous to a 67 kDa myosin-crossreactive *streptococcal* antigen (Accession No. NP_370630.1), and about 58% identity from amino acids 1-590 with a protein from *Staphylococcus epidermidis* that is a 67 kDa myosin-crossreactive *streptococcal* antigen-like protein (Accession No. NP_764331.1).

A Gapped BlastP amino acid sequence alignment showed that SEQ ID NO:12 (229 amino acids) has about 61% identity from amino acids 1-229 with a hypothetical protein from *Lactobacillus johnsonii* (Accession No. NP_965278.1), about 65% identity from amino acids 31-229 with a protein from *Lactobacillus gasseri* that is a sortase (surface protein transpeptidase) (Accession No. ZP_00046569.1), about 38% identity from amino acids 31-229 with a protein from *Enterococcus faecalis* that is a sortase family protein (Accession No. NP_816668.1), about 37% identity from amino acids 31-210 with a protein from *Lactobacillus plantarum* that is a sortase (Accession No. NP_784294.1), and about 36% identity from amino acids 31-229 with a hypothetical protein from *Lactococcus lactis* subsp. *lactis* (Accession No. NP_267269.1).

A Gapped BlastP amino acid sequence alignment showed that SEQ ID NO:14 (643 amino acids) has about 34% identity from amino acids 1-643 with a hypothetical protein from *Lactobacillus gasseri* (Accession No. ZP_00046128.1), about 38% identity from amino acids 2-456 with a hypothetical protein from *Lactobacillus gasseri* (Accession No. ZP_00046781.1), about 38% identity from amino acids 2-456 with a hypothetical protein from *Lactobacillus johnsonii* (Accession No. NP_964064.1), about 34% identity from amino acids 124-602 with a hypothetical protein from *Lactobacillus gasseri* (Accession No. ZP_00046133.1), and about 33% identity from amino acids 11-428 with a hypothetical protein from *Lactobacillus johnsonii* (Accession No. NP_964062.1).

A Gapped BlastP amino acid sequence alignment showed that SEQ ID NO:16 (1017 amino acids) has about 27% identity from amino acids 299-865 with a protein from *Lactobacillus gasseri* that is a large exoprotein involved in heme utilization or adhesion (Accession No. ZP_00046780.1), about 22% identity from amino acids 273-848 with a protein from *Lactobacillus fermentum* that is an Mlp protein (Accession No. gb|AAP41738.1), about 23% identity from amino acids 420-862 with a protein from *Lactobacillus reuteri* that is a mucus binding protein precursor (Mub) (Accession No. gb|AAF25576.1), about 25% identity from amino acids 487-859 with a hypothetical protein from *Lactobacillus johnsonii* (Accession No. NP_964063.1), and about 25% identity from amino acids 537-865 with a protein from *Lactobacillus plantarum* that is a cell surface protein precursor (Accession No. NP_786417.1).

A Gapped BlastP amino acid sequence alignment showed that SEQ ID NO:18 (4326 amino acids) has about 29% identity from amino acids 2234-4165 with a protein from *Lactobacillus gasseri* that is a large exoprotein involved in heme utilization or adhesion (Accession No. ZP_00046780.1), about 23% identity from amino acids 650-3974 with a protein from *Lactobacillus reuteri* that is a mucus binding protein precursor (Mub) (Accession No. gb|AAF25576.1), about 24% identity from amino acids 1778-4164 with a protein from *Lactobacillus fermentum* that is an Mlp protein (Accession No. gb|AAP41738.1), about 27% identity from amino acids 1673-2994 with a hypothetical protein from *Lactobacillus gasseri* (Accession No. ZP_00046645.1), and about 25% identity from amino acids 1388-2974 with a protein from *Lactobacillus plantarum* that is a cell surface protein precursor (Accession No. NP_785232.1).

A Gapped BlastP amino acid sequence alignment showed that SEQ ID NO:20 (1208 amino acids) has about 64% identity from amino acids 725-1060 with a hypothetical protein from *Lactobacillus johnsonii* (Accession No. NP_964063.1), about 29% identity from amino acids 7-999 with a hypothetical protein from *Lactobacillus gasseri* (Accession No. ZP_00046645.1), about 29% identity from amino acids 159-999 with a hypothetical protein from *Lactobacillus johnsonii* (Accession No. NP_965681.1), about 35% identity from amino acids 456-1060 with a protein from *Lactobacillus fermentum* that is an Mlp protein (Accession No. gb|AAP41738.1), and about 35% identity from amino acids 504-1060 with a protein from *Lactobacillus gasseri* that is a large exoprotein involved in heme utilization or adhesion (Accession No. ZP_00046780.1).

A Gapped BlastP amino acid sequence alignment showed that SEQ ID NO:22 (1174 amino acids) has about 30% identity from amino acids 662-1000 with a protein from *Lactobacillus plantarum* that is a cell surface protein precursor (Accession No. NP_784891.1), about 30% identity from amino acids 641-985 with a hypothetical protein from *Lactococcus lactis* subsp. *lactis* (Accession No. NP_268337.1), about 30% identity from amino acids 658-1000 with a hypothetical protein from *Lactobacillus gasseri* (Accession No. ZP_00046308.1), about 26% identity from amino acids 672-1000 with a hypothetical protein from *Lactobacillus johnsonii* (Accession No. NP_965614.1), and about 29% identity from amino acids 636-974 with a protein from *Lactobacillus reuteri* that is a mucus binding protein precursor (Mub) (Accession No. gb|AAF25576.1).

A Gapped BlastP amino acid sequence alignment showed that SEQ ID NO:24 (697 amino acids) has about 25% identity from amino acids 135-649 with a hypothetical protein from *Lactobacillus gasseri* (Accession No. ZP_00046316.1), about 24% identity from amino acids 185-681 with a hypothetical protein from *Lactobacillus johnsonii* (Accession No. NP_965614.1), about 23% identity from amino acids 86-697 with a hypothetical protein from *Lactobacillus gasseri* (Accession No. ZP_00046645.1), about 22% identity from amino acids 185-615 with a protein from *Lactobacillus reuteri* that is a mucus binding protein precursor (Mub) (Accession No. gb|AAF25576.1), and about 22% identity from amino acids 190-630 with a hypothetical protein from *Lactobacillus gasseri* (Accession No. ZP_00046308.1).

A Gapped BlastP amino acid sequence alignment showed that SEQ ID NO:26 (2319 amino acids) has about 53% identity from amino acids 10-2010 with a hypothetical protein from *Lactobacillus johnsonii* (Accession No. NP_964063.1), about 40% identity from amino acids 10-1552 with a protein from *Lactobacillus gasseri* that is a large exoprotein involved in heme utilization or adhesion (Accession No. ZP_00046780.1), about 49% identity from amino acids 1154-2119 with a protein from *Lactobacillus fermentum* that is an Mlp protein (Accession No. gb|AAP41738.1), about 33% identity from amino acids 1263-2118 with a hypothetical protein from *Lactobacillus johnsonii* (Accession No. NP_965818.1), and about 31% identity from amino acids 1270-2112 with a hypothetical protein from *Lactobacillus gasseri* (Accession No. ZP_00046645.1).

A Gapped BlastP amino acid sequence alignment showed that SEQ ID NO:28 (2650 amino acids) has about 36% identity from amino acids 1-2373 with a protein from *Lactobacillus gasseri* that is a large exoprotein involved in heme utilization or adhesion (Accession No. ZP_00046780.1), about 40% identity from amino acids 310-2086 with a hypothetical protein from *Lactobacillus johnsonii* (Accession No. NP_964063.1), about 42% identity from amino acids 1702-2463 with a protein from *Lactobacillus fermentum* that is an Mlp protein (Accession No. gb|AAP41738.1), about 30% identity from amino acids 1504-2513 with a hypothetical protein from *Lactobacillus johnsonii* (Accession No. NP_965818.1), and about 32% identity from amino acids 1987-2513 with a protein from *Bos taurus* that is a bovine homologue of human Hr44 (Accession No. emb|CAC16354.1).

A Gapped BlastP amino acid sequence alignment showed that SEQ ID NO:30 (346 amino acids) has about 33% identity from amino acids 2-204 with a hypothetical protein from *Lactobacillus gasseri* (Accession No. ZP_00046067.1), about 34% identity from amino acids 56-231 with a protein from *Lactobacillus reuteri* that is a mucus binding protein precursor (Mub) (Accession No. gb|AAF25576.1), about 26% identity from amino acids 1-346 with a hypothetical protein from *Lactobacillus johnsonii* (Accession No. NP_964510.1), about 24% identity from amino acids 2-344 with a hypothetical protein from *Lactobacillus johnsonii* (Accession No. NP_964406.1), and about 29% identity from amino acids 2-182 with a hypothetical protein from *Lactobacillus gasseri* (Accession No. ZP_00046945.1).

A Gapped BlastP amino acid sequence alignment showed that SEQ ID NO:32 (294 amino acids) has about 34% identity from amino acids 6-294 with a hypothetical protein from *Lactobacillus gasseri* (Accession No. ZP_00046131.1), about 29% identity from amino acids 6-293 with a protein from *Lactobacillus gasseri* that is an RTX toxin and related Ca2+-binding protein (Accession No. ZP_00046947.1), about 29% identity from amino acids 6-293 with a hypothetical protein from *Lactobacillus gasseri* (Accession No. ZP_00046945.1), about 30% identity from amino acids 6-284 with a hypothetical protein from *Lactobacillus gasseri* (Accession No. ZP_00046130.1), and about 30% identity from amino acids 3-279 with a hypothetical protein from *Lactobacillus johnsonii* (Accession No. NP_964510.1).

A Gapped BlastP amino acid sequence alignment showed that SEQ ID NO:34 (185 amino acids) has about 42% identity from amino acids 3-179 with a hypothetical protein from *Lactobacillus johnsonii* (Accession No. NP_964510.1), about 33% identity from amino acids 10-176 with a hypothetical protein from *Lactobacillus gasseri* (Accession No. ZP_00046067.1), about 30% identity from amino acids 10-177 with a hypothetical protein from *Lactobacillus gasseri* (Accession No. ZP_00046946.1), about 30% identity from amino acids 10-177 with a protein from *Lactobacillus gasseri* that is an RTX toxin and related Ca2+-binding protein (Accession No. ZP_00046947.1), and about 30% identity from amino acids 12-177 with a hypothetical protein from *Lactobacillus gasseri* (Accession No. ZP_00046945.1).

A Gapped BlastP amino acid sequence alignment showed that SEQ ID NO:36 (508 amino acids) has about 30% identity from amino acids 4-474 with a hypothetical protein from *Lactobacillus gasseri* (Accession No. ZP_00046128.1), about 31% identity from amino acids 9-409 with a hypothetical protein from *Lactobacillus gasseri* (Accession No. ZP_00046781.1), about 30% identity from amino acids 9-362 with a hypothetical protein from *Lactobacillus johnsonii* (Accession No. NP_964064.), about 29% identity from amino acids 13-399 with a hypothetical protein from *Lactobacillus gasseri* (Accession No. ZP_00046779.1), and about 31% identity from amino acids 13-385 with a hypothetical protein from *Lactobacillus johnsonii* (Accession No. NP_964062.1).

A Gapped BlastP amino acid sequence alignment showed that SEQ ID NO:38 (339 amino acids) has about 31% identity from amino acids 79-286 with a protein from *Lactobacillus plantarum* that is a cell surface protein precursor (Accession No. NP_784891.1), about 32% identity from amino acids 86-285 with a hypothetical protein from *Lactobacillus johnsonii* (Accession No. NP_965614.1), about 34% identity from amino acids 112-284 with a hypothetical protein from *Lactobacillus gasseri* (Accession No. ZP_00046316.1), about 42% identity from amino acids 178-293 with a hypothetical protein from *Lactobacillus gasseri* (Accession No. ZP_00046308.1), and about 29% identity from amino acids 79-282 with a protein from *Lactobacillus fermentum* that is an Mlp protein (Accession No. gb|AAP41738.1).

A Gapped BlastP amino acid sequence alignment showed that SEQ ID NO:40 (76 amino acids) has about 47% identity from amino acids 4-75 with a protein from *Lactobacillus plantarum* (Accession No. NP_786269.1), about 43% identity from amino acids 2-73 with a protein from *Clostridium acetobutylicum* that is a HypQ3 protein (Accession No. gb|AAK11585.1), about 43% identity from amino acids 2-73 with a protein from *Clostridium acetobutylicum* that is homologous to a steroid binding protein (Accession No. NP_149307.1), about 44% identity from amino acids 1-73 with a conserved hypothetical protein from *Methanosarcina acetivorans* (Accession No. NP_618599.1), and about 42% identity from amino acids 1-73 with a hypothetical protein from *Clostridium perfringens* (Accession No. NP_563415.1).

A Gapped BlastP amino acid sequence alignment showed that SEQ ID NO:42 (355 amino acids) has about 26% identity from amino acids 99-340 with a protein from *Streptococcus pyogenes* that is homologous to a surface exclusion protein (Accession Nos. NP_606538.1; NC_003485), about 26% identity from amino acids 99-340 with a protein from *Streptococcus pyogenes* that is homologous to a surface exclusion protein (Accession No. NP_664001.1), about 26% identity from amino acids 99-340 with a protein from *Streptococcus pyogenes* that is homologous to a surface exclusion protein (Accession Nos. NP_268623.1; NC_002737), about 23% identity from amino acids 116-319 with a protein from *Enterococcus faecalis* that is a surface exclusion protein (seal) precursor (Accession No. pir||S22452), and about 23% identity from amino acids 116-319 with a protein from *Enterococcus faecalis* that is a surface exclusion protein (Seal) (Accession No. NP_816976.1).

A Gapped BlastP amino acid sequence alignment showed that SEQ ID NO:44 (111 amino acids) has about 27% identity from amino acids 1-107 with a hypothetical protein from *Lactobacillus johnsonii* (Accession No. NP_965479.1), about 27% identity from amino acids 1-102 with a hypothetical protein from *Lactobacillus gasseri* (Accession No. ZP_00046710.1), about 26% identity from amino acids 31-108 with a protein from *Salmo trutta* that is a cardiac tropomyosin (Accession No. emb|CAA91434.1), about 31% identity from amino acids 31-94 with a hypothetical protein from *Homo sapiens* (Accession No. NP_653299.2), and about 25% identity from amino acids 33-108 with a protein from *Mus musculus* that is a testis-expressed gene 9 (Accession Nos. NP_033385.1; NM_009359).

A Gapped BlastP amino acid sequence alignment showed that SEQ ID NO:46 (66 amino acids) has about 58% identity from amino acids 15-62 with a hypothetical protein from *Lactobacillus gasseri* (Accession No. ZP_00046645.1), about 58% identity from amino acids 12-60 with a protein from *Lactobacillus gasseri* that is a type V secretory pathway adhesin (AidA) (Accession No. ZP_00046948.1), about 61% identity from amino acids 15-53 with a hypothetical protein from *Lactobacillus johnsonii* (Accession No. NP_964984.1), about 58% identity from amino acids 16-54 with a hypothetical protein from *Lactobacillus gasseri* (Accession No. ZP_00046307.1), and about 63% identity from amino acids 15-52 with a hypothetical protein from *Lactobacillus johnsonii* (Accession No. NP_965682.1).

A Gapped BlastP amino acid sequence alignment showed that SEQ ID NO:48 (231 amino acids) has about 44% identity from amino acids 66-231 with a protein from *Lactobacillus gasseri* that is an Apf1 protein (Accession No. gb|AAO86515.1), about 44% identity from amino acids 66-231 with a hypothetical protein from *Lactobacillus gasseri* (Accession No. ZP_00047488.1), about 44% identity from amino acids 66-231 with a protein from *Lactobacillus johnsonii* that is an aggregation promoting factor (Accession No. gb|AAN78451.1), about 40% identity from amino acids 66-231 with a protein from *Lactobacillus johnsonii* that is a surface protein, aggregation promoting factor (Accession No. NP_965551.1), and about 40% identity from amino acids 66-231 with a protein from *Lactobacillus johnsonii* that is a surface protein (Apf1) (Accession No. gb|AAN63951.1).

A Gapped BlastP amino acid sequence alignment showed that SEQ ID NO:50 (120 amino acids) has about 61% identity from amino acids 26-120 with a protein from *Lactobacillus plantarum* that is an extracellular protein (Accession No. NP_786365.1), about 54% identity from amino acids 14-120 with a protein from *Lactobacillus plantarum* that is an extracellular protein (Accession No. NP_786209.1), about 52% identity from amino acids 24-120 with a hypothetical protein from *Lactobacillus gasseri* (Accession No. ZP_00047488.1), about 54% identity from amino acids 24-120 with a protein from *Lactobacillus johnsonii* that is an aggregation promoting factor (Accession No. gb|AAN78450.1), and about 55% identity from amino acids 26-120 with a protein from *Lactobacillus johnsonii* that is an aggregation promoting factor (Accession No. gb|AAN64914.1).

A Gapped BlastP amino acid sequence alignment showed that SEQ ID NO:52 (264 amino acids) has about 27% identity from amino acids 1-94 with a protein from *Staphylococcus aureus* subsp. *aureus* that is a ser-asp rich fibrinogen-binding, bone sialoprotein-binding protein (Accession No. NP_373774.1), about 27% identity from amino acids 1-94 with a protein from *Staphylococcus aureus* subsp. *aureus* that is a ser-asp rich fibrinogen-binding, bone sialoprotein-binding protein (Accession No. NP_371087.1), and about 27% identity from amino acids 1-94 with a protein from *Staphylococcus aureus* that is homologous to a fibrinogen-binding protein (Accession No. pir||T28680).

A Gapped BlastP amino acid sequence alignment showed that SEQ ID NO:54 (991 amino acids) has about 24% identity from amino acids 97-477 with a hypothetical protein from *Plasmodium falciparum* (Accession No. NP_701725.1), about 22% identity from amino acids 270-510 with a hypothetical protein from *Dictyostelium discoideum* (Accession No. gb|AAO51593.1), about 23% identity from amino acids 47-452 with a protein from *Plasmodium falciparum* that is a starp antigen (Accession No. NP_703988.1), about 19% identity from amino acids 13-401 with a hypothetical protein from *Plasmodium falciparum* (Accession No. NP_704588.1), and about 23% identity from amino acids 44-403 with a protein from *Fusobacterium nucleatum* subsp. *nucleatum* that is a hemolysin (Accession No. NP_602617.1).

A Gapped BlastP amino acid sequence alignment showed that SEQ ID NO:56 (906 amino acids) has about 70% identity from amino acids 1-888 with a hypothetical protein from *Lactobacillus johnsonii* (Accession No. NP_964984.1), about 24% identity from amino acids 1-760 with a protein from *Lactobacillus gasseri* that is a large exoprotein involved in heme utilization or adhesion (Accession No. ZP_00046780.1), about 23% identity from amino acids 1-645 with a hypothetical protein from *Lactobacillus johnsonii* (Accession No. NP_964063.1), about 29% identity from amino acids 1-248 with a hypothetical protein from *Lactobacillus gasseri* (Accession No. ZP_00046645.1), and about 17% identity from amino acids 27-869 with a protein from *Staphylococcus epidermidis* that is a streptococcal hemagglutinin protein (Accession No. NP_765804.1).

A Gapped BlastP amino acid sequence alignment showed that SEQ ID NO:58 (566 amino acids) has about 69% identity from amino acids 4-564 with a hypothetical protein from *Lactobacillus johnsonii* (Accession No. NP_965038.1), about 66% identity from amino acids 4-564 with a protein from *Lactobacillus gasseri* that is a predicted RNA-binding protein homologous to a eukaryotic snRNP (Accession No. ZP_00045959.1), about 41% identity from amino acids 4-566 with a protein from *Enterococcus faecium* that is a predicted RNA-binding protein homologous to a eukaryotic snRNP (Accession No. ZP_00037499.1), about 41% identity from amino acids 4-566 with a protein from *Enterococcus faecalis* that is homologous to a fibronectin/fibrinogen-binding protein (Accession No. NP_814975.1), and about 41% identity from amino acids 4-557 with a protein from *Lactobacillus plantarum* that is an adherence protein (Accession No. NP_785358.1).

A Gapped BlastP amino acid sequence alignment showed that SEQ ID NO:60 (444 amino acids) has about 90% identity from amino acids 49-444 with a protein from *Lactobacillus acidophilus* that is an S-layer protein precursor (Accession No. sp|P35829|SLAP_LACAC), about 67% identity from amino acids 49-443 with a protein from *Lactobacillus helveticus* that is a surface layer protein (Accession No. emb|CAA62606.1), about 67% identity from amino acids 49-443 with a protein from *Lactobacillus helveticus* that is a surface layer protein (Accession Nos. emb|CAB46984.1; AJ388558), 66% identity from amino acids 49-443 with a protein from *Lactobacillus helveticus* that is a surface layer protein (Accession No. emb|CAB46985.1), and 66% identity from amino acids 49-443 with a protein from *Lactobacillus helveticus* that is a surface layer protein (Accession No. emb|CAB46986.1).

A Gapped BlastP amino acid sequence alignment showed that SEQ ID NO:62 (457 amino acids) has about 88% identity from amino acids 1-457 with a protein from *Lactobacillus acidophilus* that is an SB-protein (Accession Nos. CAA61561.1; X89376), about 51% identity from amino acids 1-457 with a protein from *Lactobacillus acidophilus* that is an s-layer protein precursor (Accession No. sp|P35829|SLAP_LACAC), about 44% identity from amino acids 1-456 with a protein from *Lactobacillus helveticus* that is a surface layer protein (Accession Nos. emb|CAB46985.1; AJ388559), about 44% identity from amino acids 1-456 with a protein from *Lactobacillus helveticus* that is a surface layer protein (Accession No. emb|CAA62606.1), and about 44% identity from amino acids 1-456 with a protein from *Lactobacillus helveticus* that is a surface layer protein (Accession No. emb|CAA63409.1).

A Gapped BlastP amino acid sequence alignment showed that SEQ ID NO:64 (567 amino acids) has about 35% identity from amino acids 163-311 with a protein from *Lactobacillus crispatus* that is a surface layer protein (Accession Nos. gb|AAB58734.1; AF001313), about 37% identity from amino acids 182-311 with a protein from *Lactobacillus acidophilus* that is an SB-protein (Accession Nos. emb|CAA61561.1; X89376), about 34% identity from amino acids 163-304 with a protein from *Lactobacillus helveticus* that is a proteinase(Accession Nos.

dbj|BAB72065.1; AB061775), about 25% identity from amino acids 27-311 with a protein from *Lactobacillus acidophilus* that is a surface layer protein precursor (Accession No. sp|P35829|SLAP_LACAC), and about 34% identity from amino acids 44-104 with a protein from *Homo sapiens* that is a myomesin 1 (Accession Nos. NP_003794.1; NM_003803).

A Gapped BlastP amino acid sequence alignment showed that SEQ ID NO:66 (177 amino acids) has about 28% identity from amino acids 13-170 with a protein from *Lactobacillus crispatus* that is a surface layer protein (Accession No. gb|AAB58734.1), about 26% identity from amino acids 9-170 with a protein from *Lactobacillus crispatus* that is homologous to a silent surface layer protein (Accession No. gb|AAF68972.1), about 26% identity from amino acids 42-162 with a protein from *Clostridium acetobutylicum* that is homologous to an enterotoxin (Accession No. NP_347713.1), about 26% identity from amino acids 62-166 with a protein from *Lactobacillus gasseri* that is a glycerophosphoryl diester phosphodiesterase (Accession No. ZP_00046260.1), and about 25% identity from amino acids 40-162 with a protein from *Chromobacterium violaceum* that is homologous to an rhs-related protein (Accession No. NP_900908.1).

A Gapped BlastP amino acid sequence alignment showed that SEQ ID NO:68 (173 amino acids) has about 32% identity from amino acids 68-135 with a protein from *Lama glama* that is an immunoglobulin heavy chain variable region (Accession No. emb|CAD22470.1), about 33% identity from amino acids 107-171 with a protein from *Rattus norvegicus* that is homologous to an olfactory receptor-like protein F3 (Accession No. XP_216832.2), about 27% identity from amino acids 71-165 with a protein from *Arabidopsis thaliana* (Accession No. NP_191860.1), about 29% identity from amino acids 71-160 with an environmental sequence (Accession No. gb|EAD49084.1), and about 26% identity from amino acids 80-157 with a protein from *Dictyostelium discoideum* (Accession No. gb|AAO51562.1).

A Gapped BlastP amino acid sequence alignment showed that SEQ ID NO:70 (292 amino acids) has about 66% identity from amino acids 2-292 with a protein from *Lactobacillus acidophilus* that is a surface layer protein (Accession Nos. gb|AAF65561.1; AF250229), about 28% identity from amino acids 8-291 with a protein from *Lactobacillus acidophilus* that is an S-layer protein precursor (Accession Nos. sp|P35829; SLAP_LACAC), about 42% identity from amino acids 178-291 with a protein from *Lactobacillus acidophilus* that is an SB-protein (Accession Nos. emb|CAA61561.1; X89376), about 37% identity from amino acids 137-291 with a protein from *Lactobacillus crispatus* that is a surface layer protein (Accession Nos. gb|AAB58734.1; AF001313), and about 32% identity from amino acids 90-291 with a protein from *Lactobacillus crispatus* that is homologous to a silent surface layer protein (Accession Nos. gb|AAF68972.1; AF253044).

A Gapped BlastP amino acid sequence alignment showed that SEQ ID NO:72 (216 amino acids) has about 27% identity from amino acids 35-128 with a protein from *Lactobacillus crispatus* that is a surface layer protein (Accession Nos. gb|AAB58734.1; AF001313), about 27% identity from amino acids 35-128 with a protein from *Lactobacillus crispatus* that is a silent surface layer protein (Accession No. dbj|BAC76687.1), about 28% identity from amino acids 35-128 with a protein from *Lactobacillus crispatus* that is homologous to a silent surface layer protein (Accession No. gb|AAF68972.1), about 31% identity from amino acids 41-126 with an environmental sequence (Accession No. gb|EAG77017.1), and about 28% identity from amino acids 45-169 with an environmental sequence (Accession No. gb|EAC33545.1).

A Gapped BlastP amino acid sequence alignment showed that SEQ ID NO:74 (359 amino acids) has about 27% identity from amino acids 34-228 with a hypothetical protein from *Cytophaga hutchinsonii* (Accession No. ZP_00118765.1), about 28% identity from amino acids 3-160 with a protein from *Lactobacillus crispatus* that is a silent surface layer protein (Accession No. dbj|BAC76687.1), about 26% identity from amino acids 98-256 with a protein from *Lactobacillus delbrueckii* subsp. *bulgaricus* that is a lactocepin (EC 3.4.21.96) precursor (Accession No. pir||JC6032), about 27% identity from amino acids 4-160 with a protein from *Lactobacillus crispatus* that is a surface layer protein (Accession No. gb|AAB58734.1), and about 28% identity from amino acids 3-160 with a protein from *Lactobacillus crispatus* that is homologous to a silent surface layer protein (Accession No. gb|AAF68972.1).

A Gapped BlastP amino acid sequence alignment showed that SEQ ID NO:76 (1676 amino acids) has about 42% identity from amino acids 926-1528 with a hypothetical protein from *Lactobacillus johnsonii* (Accession No. NP_965634.1), about 40% identity from amino acids 839-1528 with a protein from *Streptococcus pyogenes* that is a surface protein R28 (Accession Nos. gb|AAD39085.1; AF091393), about 39% identity from amino acids 839-1528 with a protein from *Streptococcus agalactiae* that is a surface protein Rib (Accession No. NP_687467.1), about 39% identity from amino acids 839-1528 with a protein from *Streptococcus agalactiae* that is a rib protein (Accession No. pir||T28681), and about 33% identity from amino acids 752-1528 with a protein from *Enterococcus faecium* that is homologous to a surface protein precursor (Accession No. emb|CAD32315.1).

A Gapped BlastP amino acid sequence alignment showed that SEQ ID NO:78 (1924 amino acids) has about 44% identity from amino acids 921-1796 with a hypothetical protein from *Lactobacillus johnsonii* (Accession No. NP_965634.1), about 29% identity from amino acids 807-1923 with a protein from *Streptococcus pyogenes* that is a surface protein R28 (Accession No. gb|AAD39085.1), about 30% identity from amino acids 807-1923 with a protein from *Streptococcus agalactiae* that is a surface protein Rib (Accession No. NP_687467.1), about 30% identity from amino acids 807-1923 with a protein from *Streptococcus agalactiae* that is a rib protein (Accession No. pir||T28681), and about 31% identity from amino acids 984-1812 with a protein from *Lactobacillus fermentum* that is an Rlp protein (Accession No. gb|AAP41737.1).

A Gapped BlastP amino acid sequence alignment showed that SEQ ID NO:80 (353 amino acids) has about 22% identity from amino acids 128-344 with a protein from *Haemophilus somnus* that is a large exoprotein involved in heme utilization or adhesion (Accession No. ZP_00133279.1), about 22% identity from amino acids 128-344 with a protein from *Haemophilus somnus* that is a large exoprotein involved in heme utilization or adhesion (Accession No. ZP_00133280.1), about 26% identity from amino acids 137-278 with an environmental sequence (Accession No. gb|EAC64082.1), and about 27% identity from amino acids 84-250 with an environmental sequence (Accession No. gb|EAJ12295.1).

A Gapped BlastP amino acid sequence alignment showed that SEQ ID NO:82 (364 amino acids) has about 46% identity from amino acids 33-222 with a protein from

*Listeria innocua* that is an autolysin, amidase (Accession No. NP_472032.1), about 45% identity from amino acids 49-237 with a protein from *Listeria monocytogenes* that is an autolysin, amidase (Accession No. gb|AAC46384.1), about 45% identity from amino acids 49-237 with a protein from *Listeria monocytogenes* that is an autolysin, amidase (Accession No. NP_466081.1), about 45% identity from amino acids 49-237 with a protein from *Listeria monocytogenes* that is an AMI protein (Accession No. gb|AAC45605.1), and about 39% identity from amino acids 49-299 with a protein from *Listeria monocytogenes* that is an Ami 4b protein (Accession No. emb|CAC20640.1; AJ276390).

A Gapped BlastP amino acid sequence alignment showed that SEQ ID NO:84 (334 amino acids) has about 87% identity from amino acids 1-333 with a protein from *Lactobacillus johnsonii* that is a rod shape-determining protein (MreB) (Accession No. NP_964817.1), about 86% identity from amino acids 23-333 with a protein from *Lactobacillus gasseri* that is an actin-like ATPase involved in cell morphogenesis (Accession No. ZP_00047434.1), about 75% identity from amino acids 1-331 with a protein from *Lactobacillus plantarum* that is a cell shape determining protein (MreB) (Accession No. NP_785793.1), about 66% identity from amino acids 2-331 with a protein from *Leuconostoc mesenteroides* subsp. *mesenteroides* that is an actin-like ATPase involved in cell morphogenesis (Accession No. ZP_00063690.1), and about 66% identity from amino acids 1-333 with a protein from *Listeria innocua* that is homologous to a cell-shape determining protein (MreB) (Accession No. NP_470919.1).

A Gapped BlastP amino acid sequence alignment showed that SEQ ID NO:86 (329 amino acids) has about 86% identity from amino acids 1-329 with a protein from *Lactobacillus johnsonii* that is an mreB-like protein (Accession No. NP_964798.1), about 86% identity from amino acids 1-329 with a protein from *Lactobacillus gasseri* that is an actin-like ATPase involved in cell morphogenesis (Accession No. ZP_00046248.1), about 65% identity from amino acids 1-325 with a protein from *Lactobacillus plantarum* that is a cell shape determining protein (MreB) (Accession No. NP_785826.1), about 65% identity from amino acids 1-328 with a protein from *Leuconostoc mesenteroides* subsp. *mesenteroides* that is an actin-like ATPase involved in cell morphogenesis (Accession No. ZP_00063606.1), and about 64% identity from amino acids 2-328 with a protein from *Bacillus anthracis* that is an mbl protein (Accession No. NP_847679.1).

A Gapped BlastP amino acid sequence alignment showed that SEQ ID NO:88 (283 amino acids) has about 64% identity from amino acids 1-281 with a protein from *Lactobacillus gasseri* that is a cell shape-determining protein (Accession No. ZP_00047435.1), about 63% identity from amino acids 1-281 with a protein from *Lactobacillus johnsonii* that is a rod shape-determining protein (MreC) (Accession No. NP_964818.1), about 42% identity from amino acids 1-279 with a protein from *Lactobacillus plantarum* that is a cell-shape determining protein (MreC) (Accession No. NP_785792.1), about 38% identity from amino acids 1-279 with a protein from *Enterococcus faecium* that is a cell shape-determining protein (Accession No. ZP_00037396.1), and about 41% identity from amino acids 33-281 with a protein from *Leuconostoc mesenteroides* subsp. *mesenteroides* that is a cell shape determining protein (Accession No. ZP_00063689.1).

A Gapped BlastP amino acid sequence alignment showed that SEQ ID NO:90 (179 amino acids) has about 42% identity from amino acids 1-171 with a protein from *Lactobacillus johnsonii* that is a rod-shape determining protein (MreD) (Accession No. NP_964819.1), about 39% identity from amino acids 15-171 with a protein from *Lactobacillus gasseri* that is a cell shape determining protein (Accession No. ZP_00047436.1), about 26% identity from amino acids 6-159 with a protein from *Lactobacillus plantarum* that is a cell shape determining protein (MreD) (Accession No. NP_785791.1), about 28% identity from amino acids 3-122 with a protein from *Oceanobacillus iheyensis* that is a cell-shape determining protein (Accession No. NP_692972.1), and about 29% identity from amino acids 11-132 with a protein from *Lactococcus lactis* subsp. *lactis* that is a cell shape determining protein (Accession No. NP_268387.1).

A Gapped BlastP amino acid sequence alignment showed that SEQ ID NO:92 (397 amino acids) has about 61% identity from amino acids 1-397 with a hypothetical protein from *Lactobacillus johnsonii* (Accession No. NP_964801.1), about 60% identity from amino acids 1-397 with a protein from *Lactobacillus gasseri* that is a cell division membrane protein (Accession No. ZP_00046251.1), about 50% identity from amino acids 13-392 with a protein from *Lactobacillus plantarum* that is a rod shape-determining protein (Accession No. NP_785823.1), about 41% identity from amino acids 5-384 with a protein from *Enterococcus faecalis* that is a cell division protein in the FtsW/RodA/SpoVE family (Accession Nos. NP_816148.1), and about 41% identity from amino acids 16-368 with a protein from *Lactobacillus plantarum* that is a rod-shape determining protein (Accession No. NP_785596.1).

A Gapped BlastP amino acid sequence alignment showed that SEQ ID NO:94 (437 amino acids) has about 91% identity from amino acids 1-437 with a protein from *Lactobacillus gasseri* that is a UDP-N-acetylmuramate-alanine ligase (Accession No. ZP_00046723.1), about 91% identity from amino acids 1-437 with a protein from *Lactobacillus johnsonii* that is a UDP-N-acetyl muramate-alanine ligase (Accession No. NP_965470.1), about 56% identity from amino acids 2-434 with a protein from *Lactobacillus plantarum* that is a UDP-N-acetylmuramate-alanine ligase (Accession No. NP_785073.1), about 56% identity from amino acids 5-437 with a protein from *Leuconostoc mesenteroides* subsp. *mesenteroides* that is a UDP-N-acetylmuramate-alanine ligase (Accession No. ZP_00064100.1), and about 51% identity from amino acids 4-437 with a protein from *Enterococcus faecalis* that is a UDP-N-acetylmuramate-alanine ligase (Accession No. NP_815590.1).

A Gapped BlastP amino acid sequence alignment showed that SEQ ID NO:96 (452 amino acids) has about 87% identity from amino acids 3-452 with a protein from *Lactobacillus gasseri* that is a UDP-N-acetylmuramyl tripeptide synthase (Accession No. ZP_00046234.1), about 86% identity from amino acids 3-452 with a hypothetical protein from *Lactobacillus johnsonii* (Accession No. NP_964783.1), about 55% identity from amino acids 3-452 with a protein from *Lactobacillus plantarum* that is homologous to a UDP-N-acetylmuramyl tripeptide synthase (Accession No. NP_785844.1), about 50% identity from amino acids 3-452 with a protein from *Enterococcus faecalis* that is a mur ligase family protein (Accession No. NP_816226.1), and about 51% identity from amino acids 3-451 with a protein from *Leuconostoc mesenteroides* subsp. *mesenteroides* that is a UDP-N-acetylmuramyl tripeptide synthase (Accession No. ZP_00063654.1).

A Gapped BlastP amino acid sequence alignment showed that SEQ ID NO:98 (532 amino acids) has about 83% identity from amino acids 11-528 with a protein from *Lactobacillus johnsonii* that is a UDP-N-acetylmuramoyl-L-alanyl-D-glutamate-lysine ligase (Accession No. NP_965690.1), about 83% identity from amino acids 11-528 with a protein from *Lactobacillus gasseri* that is a UDP-N-acetylmuramyl tripeptide synthase (Accession No. ZP_00046637.1), about 44% identity from amino acids 10-524 with a protein from *Leuconostoc mesenteroides* subsp. *mesenteroides* that is a UDP-N-acetylmuramyl tripeptide synthase (Accession No. ZP_00062837.1), about 43% identity from amino acids 24-522 with a protein from *Enterococcus faecium* that is a UDP-N-acetylmuramyl tripeptide synthase (Accession No. ZP_00036035.1), and about 42% identity from amino acids 10-522 with a protein from *Enterococcus faecalis* that is homologous to a UDP-N-acetylmuramoylalanyl-D-glutamate-2,6-diaminopimelate ligase (Accession No. NP_814420.1).

A Gapped BlastP amino acid sequence alignment showed that SEQ ID NO:100 (459 amino acids) has about 78% identity from amino acids 1-459 with a protein from *Lactobacillus johnsonii* that is a UDP-N-acetylmuramoylalanine-D-glutamate ligase (Accession No. NP_964826.1), about 80% identity from amino acids 89-459 with a protein from *Lactobacillus gasseri* that is a UDP-N-acetylmuramoylalanine-D-glutamate ligase (Accession No. ZP_00046265.1), about 49% identity from amino acids 1-456 with a protein from *Bacillus anthracis* that is a UDP-N-acetylmuramoylalanine-D-glutamate ligase (Accession No. NP_846291.1), about 49% identity from amino acids 1-456 with a protein from *Bacillus cereus* that is a UDP-N-acetylmuramoylalanine-D-glutamate ligase (Accession No. NP_980253.1), and about 49% identity from amino acids 1-456 with a protein from *Bacillus cereus* that is a UDP-N-acetylmuramoylalanine-D-glutamate ligase (Accession No. NP_833632.1).

A Gapped BlastP amino acid sequence alignment showed that SEQ ID NO:102 (368 amino acids) has about 79% identity from amino acids 1-364 with a protein from *Lactobacillus gasseri* that is a UDP-N-acetylglucosamine:LPS N-acetylglucosamine transferase (Accession No. ZP_00046266.1), about 78% identity from amino acids 1-366 with a protein from *Lactobacillus johnsonii* that is a UDP-N-acetylglucosamine-N-acetylmuramyl-(pentapeptide) pyrophosphoryl-undecaprenol N-acetylglucosamine transferase (Accession No. NP_964827.1), about 49% identity from amino acids 1-366 with a protein from *Lactobacillus plantarum* that is a UDP-N-acetylglucosamine-N-acetylmuramyl-(pentapeptide) pyrophosphoryl-undecaprenol N-acetylglucosamine transferase (Accession No. NP_785692.1), about 46% identity from amino acids 1-368 with a protein from *Bacillus halodurans* that is a UDP-N-acetylglucosamine-N-acetylmuramyl-(pentapeptide) pyrophos (Accession No. NP_243431.1), and about 47% identity from amino acids 1-366 with a protein from *Enterococcus hirae* that is a UDP-N-acetylglucosamine-N-acetylmuramyl-(pentapeptide) pyrophosphoryl-undecaprenol N-acetylglucosamine transferase (Accession No. sp|O07670|MURG_ENTHR).

A Gapped BlastP amino acid sequence alignment showed that SEQ ID NO:104 (322 amino acids) has about 67% identity from amino acids 4-322 with a protein from *Lactobacillus gasseri* that is a UDP-N-acetylmuramyl pentapeptide phosphotransferase/UDP-N-acetylglucosamine-1-phosphate transferase (Accession No. ZP_00047442.1), about 67% identity from amino acids 4-322 with a protein from *Lactobacillus johnsonii* that is a phospho-N-acetylmuramoyl-pentapeptide-transferase (Accession No. NP_964825.1), about 49% identity from amino acids 11-319 with a protein from *Lactobacillus plantarum* that is a phospho-N-acetylmuramoyl-pentapeptide-transferase (Accession No. NP_785694.1), about 47% identity from amino acids 9-320 with a protein from *Enterococcus faecium* that is a UDP-N-acetylmuramyl pentapeptide phosphotransferase/UDP-N-acetylglucosamine-1-phosphate transferase (Accession No. ZP_00037828.1), and about 47% identity from amino acids 9-320 with a protein from *Enterococcus faecalis* that is a phospho-N-acetylmuramoyl-pentapeptide-transferase (Accession No. NP_814728.1).

A Gapped BlastP amino acid sequence alignment showed that SEQ ID NO:106 (215 amino acids) has about 54% identity from amino acids 15-214 with a hypothetical protein from *Lactobacillus johnsonii* (Accession No. NP_965527.1), about 54% identity from amino acids 15-214 with a protein from *Lactobacillus gasseri* that is a muramidase (flagellum-specific) (Accession No. ZP_00046365.1), about 42% identity from amino acids 1-215 with a protein from *Listeria monocytogenes* that is homologous to an N-acetylmuramoyl-L-alanine amidase (autolysin) (Accession No. NP_464740.1), about 42% identity from amino acids 1-215 with a protein from *Listeria innocua* that is homologous to an N-acetylmuramoyl-L-alanine amidase (autolysin) (Accession Nos. NP_470515.1; NC_003212), and about 53% identity from amino acids 71-215 with a protein from *Lactococcus* lactis subsp. *lactis* that is an N-acetylmuramidase (Accession No. NP_267521.1).

A Gapped BlastP amino acid sequence alignment showed that SEQ ID NO:108 (409 amino acids) has about 43% identity from amino acids 1-262 with a hypothetical protein from *Lactobacillus johnsonii* (Accession No. NP_964171.1), about 39% identity from amino acids 26-257 with a protein from *Listeria monocytogenes* that is homologous to an autolysin (EC 3.5.1.28) (N-acetylmuramoyl-L-alanine amidase) (Accession No. NP_464601.1), about 38% identity from amino acids 16-236 with a protein from *Listeria innocua* that is homologous to an autolysin, N-acetylmuramidase (Accession No. NP_472166.1), about 34% identity from amino acids 16-274 with a protein from *Listeria monocytogenes* that is homologous to an autolysin, N-acetylmuramidase (Accession No. NP_466213.1), and about 39% identity from amino acids 40-222 with a protein from *Enterococcus faecium* that is homologous to a glycosidase (GlyA) (Accession No. gb|AAK72496.1).

A Gapped BlastP amino acid sequence alignment showed that SEQ ID NO:110 (153 amino acids) has about 47% identity from amino acids 105-152 with a protein from *Oenococcus oeni* that is a muramidase (flagellum-specific) (Accession No. ZP_00069384.1), about 53% identity from amino acids 108-150 with a protein from *Bacillus subtilis* that is an N-acetylmuramoyl-L-alanine amidase (Accession Nos. NP_389164.1; NC_000964), about 48% identity from amino acids 104-150 with a hypothetical protein from *Chloroflexus aurantiacus* (Accession No. ZP_00019741.1), about 54% identity from amino acids 107-152 with a protein from *Deinococcus radiodurans* that is homologous to a cell wall protein (Accession No. NP_294634.1), and about 47% identity from amino acids 109-152 with a protein from *Lactococcus* lactis subsp. *lactis* that is an N-acetylmuramidase (Accession No. NP_266697.1).

A Gapped BlastP amino acid sequence alignment showed that SEQ ID NO:112 (360 amino acids) has about 71% identity from amino acids 1-360 with a protein from *Lac-*

*tobacillus gasseri* that is a D-alanine-D-alanine ligase and related ATP-grasp enzyme (Accession No. ZP_00047036.1), about 71% identity from amino acids 1-360 with a protein from *Lactobacillus johnsonii* that is a D-alanine-D-alanine ligase (Accession No. NP_964124.1), about 41% identity from amino acids 3-348 with a protein from *Escherichia coli* that is a D-alanine-D-alanine ligase A (Accession No. NP_308458.1), about 41% identity from amino acids 3-348 with a protein from *Escherichia coli* that is a D-alanine-D-alanine ligase A (Accession Nos. NP_752421.1), and about 39% identity from amino acids 4-348 with a protein from Oceanobacillus iheyensis that is a D-alanine-D-alanine ligase A (Accession No. NP_692227.1).

A Gapped BlastP amino acid sequence alignment showed that SEQ ID NO:114 (327 amino acids) has about 41% identity from amino acids 29-326 with a hypothetical protein from *Lactobacillus johnsonii* (Accession No. NP_965730.1), about 43% identity from amino acids 79-326 with a hypothetical protein from *Lactobacillus gasseri* (Accession No. ZP_00046598.1), about 43% identity from amino acids 58-165 with a hypothetical protein from *Lactobacillus gasseri* (Accession No. ZP_00046597.1), and about 38% identity from amino acids 141-187 with a protein from *Clostridium perfringens* that is homologous to a cell division protein (Accession No. NP_561266.1).

A Gapped BlastP amino acid sequence alignment showed that SEQ ID NO:116 (455 amino acids) has about 77% identity from amino acids 1-454 with a protein from *Lactobacillus johnsonii* that is a UDP-N-acetylmuramoylalanyl-D-glutamyl-2,6-diaminopimelate-D-alanyl-D-alanyl ligase (Accession No. NP_964286.1), about 79% identity from amino acids 150-454 with a protein from *Lactobacillus gasseri* that is a UDP-N-acetylmuramyl pentapeptide synthase (Accession No. ZP_00047007.1), about 54% identity from amino acids 1-454 with a protein from *Lactobacillus plantarum* that is a UDP-N-acetylmuramoylalanyl-D-glutamyl-2,6-diaminopimelate-D-alanyl-D-alanine ligase (Accession No. NP_784298.1), about 46% identity from amino acids 1-454 with a protein from *Enterococcus faecalis* that is a UDP-N-acetylmuramoylalanyl-D-glutamyl-2,6-diaminopimelate-D-alanyl-D-alanyl ligase (Accession No. NP_814587.1), and about 43% identity from amino acids 1-454 with a protein from *Streptococcus pyogenes* that is homologous to a D-Ala-D-Ala adding enzyme (Accession No. NP_269511.1).

A Gapped BlastP amino acid sequence alignment showed that SEQ ID NO:118 (432 amino acids) has about 40% identity from amino acids 1-426 with a protein from *Lactobacillus plantarum* that is a serine-type D-Ala-D-Ala carboxypeptidase (Accession No. NP_786467.1), about 51% identity from amino acids 37-317 with a protein from *Lactobacillus johnsonii* that is a D-alanyl-D-alanine carboxypeptidase (Accession No. NP_964537.1), about 49% identity from amino acids 37-317 with a protein from *Lactobacillus gasseri* that is a D-alanyl-D-alanine carboxypeptidase (Accession No. ZP_00047293.1), about 38% identity from amino acids 5-430 with a protein from *Bacillus subtilis* that is a D-alanyl-D-alanine carboxypeptidase (penicillin-binding protein 5) (Accession No. NP_387891.1), and about 40% identity from amino acids 56-430 with a protein from *Bacillus subtilis* that is a penicillin binding protein 5 (Accession No. gb|AAA22375.1).

A Gapped BlastP amino acid sequence alignment showed that SEQ ID NO:120 (441 amino acids) has about 88% identity from amino acids 11-430 with a protein from *Lactobacillus johnsonii* that is a UDP-N-acetylglucosamine 1-carboxyvinyltransferase 1 (Accession No. NP_964240.1), about 90% identity from amino acids 1-382 with a protein from *Lactobacillus gasseri* that is a UDP-N-acetylglucosamine enolpyruvyl transferase (Accession No. ZP_00047072.1), about 64% identity from amino acids 11-435 with a protein from *Lactobacillus plantarum* that is a UDP-N-acetylglucosamine 1-carboxyvinyltransferase (Accession No. NP_784290.1), about 62% identity from amino acids 11-429 with a protein from *Leuconostoc mesenteroides* subsp. *mesenteroides* that is a UDP-N-acetylglucosamine enolpyruvyl transferase (Accession No. ZP_00063218.1), and about 58% identity from amino acids 11-436 with a protein from *Enterococcus faecalis* that is a UDP-N-acetylglucosamine 1-carboxyvinyltransferase 2 (Accession No. NP_814899.1).

A Gapped BlastP amino acid sequence alignment showed that SEQ ID NO:122 (459 amino acids) has about 82% identity from amino acids 1-459 with a protein from *Lactobacillus johnsonii* that is a UDP-N-acetylglucosamine-1-phosphate uridyltransferase (Accession No. NP_964224.1), about 81% identity from amino acids 1-459 with a protein from *Lactobacillus gasseri* that is an N-acetylglucosamine-1-phosphate uridyltransferase (Accession No. ZP_00047088.1), about 62% identity from amino acids 3-453 with a protein from *Lactobacillus plantarum* that is a UDP-N-acetylglucosamine pyrophosphorylase (Accession No. NP_784257.1), about 61% identity from amino acids 3-457 with a protein from *Enterococcus faecalis* that is a UDP-N-acetylglucosamine pyrophosphorylase (Accession No. NP_813869.1), and about 56% identity from amino acids 1-453 with a protein from *Streptococcus agalactiae* that is a UDP-N-acetylglucosamine pyrophosphorylase (Accession No. NP_688532.1).

A Gapped BlastP amino acid sequence alignment showed that SEQ ID NO:124 (244 amino acids) has about 69% identity from amino acids 1-239 with a protein from *Lactobacillus johnsonii* that is an undecaprenyl pyrophosphate synthetase (Accession No. NP_965298.1), about 68% identity from amino acids 1-239 with a protein from *Lactobacillus gasseri* that is an undecaprenyl pyrophosphate synthase (Accession No. ZP_00046589.1), about 57% identity from amino acids 10-242 with a protein from Oenococcus oeni that is an undecaprenyl pyrophosphate synthase (Accession No. ZP_00070158.1), about 59% identity from amino acids 10-237 with a protein from *Listeria* innocua that is homologous to an undecaprenyl diphosphate synthase (Accession No. NP_470688.1), and about 56% identity from amino acids 10-242 with a protein from *Enterococcus faecalis* that is an undecaprenyl diphosphate synthase (Accession No. NP_816141.1).

A Gapped BlastP amino acid sequence alignment showed that SEQ ID NO:126 (389 amino acids) has about 72% identity from amino acids 1-377 with a protein from *Lactobacillus gasseri* that is a UDP-N-acetylmuramyl pentapeptide phosphotransferase/UDP-N-acetylglucosamine-1-phosphate transferase (Accession No. ZP_00046896.1), about 72% identity from amino acids 1-377 with a hypothetical protein from *Lactobacillus johnsonii* (Accession No. NP_964696.1), about 72% identity from amino acids 1-375 with a protein from *Lactobacillus delbrueckii* that is an RgpG protein (Accession No. gb|AAK00329.1), about 54% identity from amino acids 2-355 with a protein from *Lactobacillus plantarum* that is an undecaprenyl-phosphate N-acetyl-glucosaminyl transferase (Accession No. NP_784485.1), and about 51% identity from amino acids 1-358 with a protein from *Enterococcus faecalis* that is a glycosyl transferase, group 4 family protein (Accession No. NP_815860.1).

A Gapped BlastP amino acid sequence alignment showed that SEQ ID NO:128 (313 amino acids) has about 38% identity from amino acids 51-311 with a hypothetical protein from *Lactobacillus johnsonii* (Accession No. NP_965759.1), about 38% identity from amino acids 51-311 with a protein from *Lactobacillus gasseri* that is in the beta-lactamase class C and other penicillin binding protein family (Accession No. ZP_00046847.1), about 31% identity from amino acids 30-296 with a protein from *Enterococcus faecalis* that is homologous to a penicillin-binding protein (Accession No. NP_814494.1), about 31% identity from amino acids 12-290 with a protein from *Lactobacillus plantarum* that is a serine-type D-Ala-D-Ala carboxypeptidase (Accession No. NP_785548.1), and about 33% identity from amino acids 38-289 with a protein from *Enterococcus faecium* that is in the beta-lactamase class C and other penicillin binding protein family (Accession No. ZP_00035472.1).

A Gapped BlastP amino acid sequence alignment showed that SEQ ID NO:130 (374 amino acids) has about 51% identity from amino acids 49-304 with a protein from *Lactobacillus delbrueckii* subsp. *bulgaricus* that is a conserved hypothetical penicillin-binding protein (Accession No. gb|AAM22482.1), about 30% identity from amino acids 67-362 with a protein from *Lactobacillus plantarum* that is a serine-type D-Ala-D-Ala carboxypeptidase (Accession No. NP_784838.1), about 24% identity from amino acids 46-371 with a protein from *Streptococcus agalactiae* (Accession No. NP_735091.1), about 24% identity from amino acids 46-371 with a protein from *Streptococcus agalactiae* that is homologous to a lipoprotein (Accession No. NP_687676.1), and about 27% identity from amino acids 48-346 with a protein from *Enterococcus faecalis* that is homologous to a penicillin-binding protein (Accession No. NP_814494.1).

A Gapped BlastP amino acid sequence alignment showed that SEQ ID NO:132 (702 amino acids) has about 69% identity from amino acids 1-699 with a protein from *Lactobacillus johnsonii* that is a penicillin-binding protein 2B (Accession No. NP_965426.1), about 71% identity from amino acids 22-699 with a protein from *Lactobacillus gasseri* that is a cell division protein FtsI/penicillin-binding protein 2 (Accession No. ZP_00046928.1), about 44% identity from amino acids 1-700 with a protein from *Lactobacillus plantarum* that is a penicillin binding protein 2B (Accession No. NP_785166.1), about 39% identity from amino acids 19-699 with a protein from *Enterococcus faecalis* that is a penicillin-binding protein 2B (Accession No. NP_816479.1), and about 37% identity from amino acids 12-702 with a protein from *Leuconostoc mesenteroides* subsp. *mesenteroides* that is a cell division protein FtsI/penicillin-binding protein 2 (Accession No. ZP_00063639.1).

A Gapped BlastP amino acid sequence alignment showed that SEQ ID NO:134 (704 amino acids) has about 75% identity from amino acids 34-704 with a protein from *Lactobacillus johnsonii* that is a penicillin-binding protein IF (Accession No. NP_965485.1), about 74% identity from amino acids 34-704 with a protein from *Lactobacillus gasseri* that is a membrane carboxypeptidase (penicillin-binding protein) (Accession No. ZP_00046704.1), about 53% identity from amino acids 34-703 with a protein from *Lactobacillus plantarum* that is a penicillin-binding protein 2a (Accession No. NP_785034.1), about 47% identity from amino acids 24-699 with a protein from *Enterococcus faecalis* that is a penicillin-binding protein 2a (Accession No. NP_814430.1), and about 47% identity from amino acids 61-704 with a protein from *Listeria monocytogenes* that is homologous to a penicillin-binding protein (Accession No. NP_465753.1).

A Gapped BlastP amino acid sequence alignment showed that SEQ ID NO:136 (343 amino acids) has about 68% identity from amino acids 26-337 with a hypothetical protein from *Lactobacillus johnsonii* (Accession No. NP_965496.1), about 67% identity from amino acids 26-338 with a protein from *Lactobacillus gasseri* that is in the beta-lactamase class C and other penicillin binding protein family (Accession No. ZP_00046698.1), about 67% identity from amino acids 27-178 with a protein from *Lactobacillus reuteri* that is homologous to a penicillin-binding protein class C fmt-like protein (Accession No. gb|AAP97059.1), about 29% identity from amino acids 27-343 with a protein from *Streptococcus mutans* that is homologous to a penicillin-binding protein class C, fmt-like protein (Accession No. NP_721297.1), and about 30% identity from amino acids 39-323 with a protein from *Streptococcus agalactiae* that is homologous to a lipoprotein (Accession No. NP_687676.1).

A Gapped BlastP amino acid sequence alignment showed that SEQ ID NO:138 (776 amino acids) has about 71% identity from amino acids 1-679 with a protein from *Lactobacillus gasseri* that is a membrane carboxypeptidase (penicillin-binding protein) (Accession No. ZP_00045945.1), about 71% identity from amino acids 1-680 with a protein from *Lactobacillus johnsonii* that is a penicillin binding protein 1A (Accession No. NP_965052.1), about 45% identity from amino acids 19-688 with a protein from *Leuconostoc mesenteroides* subsp. *mesenteroides* that is a membrane carboxypeptidase (penicillin-binding protein) (Accession No. ZP_00064357.1), about 45% identity from amino acids 1-688 with a protein from *Lactobacillus plantarum* that is a penicillin-binding protein 1 a (Accession No. NP_785323.1), and about 45% identity from amino acids 20-651 with a protein from *Enterococcus faecium* that is a membrane carboxypeptidase (penicillin-binding protein) (Accession No. ZP_00035508.1).

A Gapped BlastP amino acid sequence alignment showed that SEQ ID NO:140 (218 amino acids) has about 72% identity from amino acids 7-217 with a protein from *Lactobacillus gasseri* that is a penicillin-binding protein-related factor A that is homologous to a recombinase (Accession No. ZP_00045946.1), about 74% identity from amino acids 7-212 with a protein from *Lactobacillus johnsonii* that is a recombination protein (RecU) (Accession No. NP_965051.1), about 53% identity from amino acids 7-213 with a protein from *Enterococcus hirae* that is a penicillin binding protein-related factor A (Accession No. emb|CAC21567.1), about 57% identity from amino acids 7-212 with a protein from *Lactobacillus plantarum* that is a recombination protein (RecU) (Accession No. NP_785324.1), and about 52% identity from amino acids 7-213 with a protein from *Enterococcus faecium* that is a penicillin-binding protein-related factor A that is homologous to a recombinase (Accession No. ZP_00035507.1).

A Gapped BlastP amino acid sequence alignment showed that SEQ ID NO:142 (364 amino acids) has about 46% identity from amino acids 48-290 with a protein from *Lactobacillus delbrueckii* subsp. *bulgaricus* that is a conserved hypothetical penicillin binding protein (Accession No. gb|AAM22482.1), about 30% identity from amino acids 37-337 with a protein from *Lactobacillus plantarum* that is a serine-type D-Ala-D-Ala carboxypeptidase (Accession No. NP_784838.1), about 27% identity from amino acids 19-336 with a protein from *Enterococcus faecalis* that is homologous to a penicillin-binding protein (Accession No. NP_814494.1), about 31% identity from amino acids 78-299 with a protein from *Streptococcus mutans* that is homologous to a penicillin-binding protein class C, fmt-like protein (Accession No. NP_721297.1), and about 27% identity from amino acids 48-336 with a protein from *Lactobacillus plantarum* that is a serine-type D-Ala-D-Ala carboxypeptidase (Accession No. NP_785548.1).

A Gapped BlastP amino acid sequence alignment showed that SEQ ID NO:144 (369 amino acids) has about 46% identity from amino acids 46-299 with a protein from *Lactobacillus delbrueckii* subsp. *bulgaricus* that is a conserved hypothetical penicillin binding protein (Accession No. gb|AAM22482.1), about 30% identity from amino acids 16-350 with a protein from *Lactobacillus plantarum* that is a serine-type D-Ala-D-Ala carboxypeptidase (Accession No. NP_784838.1), about 29% identity from amino acids 26-362 with a protein from *Staphylococcus aureus* subsp. *aureus* that is an autolysis and methicillin resistant-related protein (Accession No. NP_371581.1), about 28% identity from amino acids 22-304 with a protein from *Staphylococcus epidermidis* that is an autolysis and methicillin resistant-related protein (Accession No. NP_764309.1), and about 28% identity from amino acids 16-341 with a protein from *Lactobacillus plantarum* that is a serine-type D-Ala-D-Ala carboxypeptidase (Accession No. NP_785548.1).

A Gapped BlastP amino acid sequence alignment showed that SEQ ID NO:146 (720 amino acids) has about 60% identity from amino acids 14-719 with a protein from *Lactobacillus gasseri* that is a cell division protein FtsI/penicillin-binding protein 2 (Accession No. ZP_00047441.1), about 60% identity from amino acids 14-719 with a protein from *Lactobacillus johnsonii* that is a penicillin-binding protein 2B (Accession No. NP_964824.1), about 43% identity from amino acids 42-719 with a protein from *Lactobacillus plantarum* that is a penicillin-binding protein 2B (Accession No. NP_785695.1), about 39% identity from amino acids 42-718 with a protein from *Listeria innocua* that is homologous to a penicillin-binding protein 2B (Accession No. NP_471479.1), and about 38% identity from amino acids 42-718 with a protein from *Listeria monocytogenes* that is homologous to a penicillin-binding protein 2B (Accession No. NP_465563.1).

A Gapped BlastP amino acid sequence alignment showed that SEQ ID NO:148 (504 amino acids) has about 74% identity from amino acids 1-503 with a protein from *Lactobacillus johnsonii* that is a D-alanine-activating enzyme (Accession No. NP_965763.1), about 73% identity from amino acids 1-503 with a protein from *Lactobacillus gasseri* that is in the non-ribosomal peptide synthetase module and related protein family (Accession No. ZP_00046843.1), about 53% identity from amino acids 1-503 with a protein from *Lactobacillus plantarum* that is a D-alanine-activating enzyme (DltA) (Accession No. NP_785546.1), about 51% identity from amino acids 1-503 with a protein from *Lactobacillus rhamnosus* that is a D-alanine-poly (phosphoribitol) ligase subunit I (D-alanine-activating enzyme) (Accession No. sp|P35854|DLTA_LACRH), and about 49% identity from amino acids 1-504 with a protein from *Streptococcus agalactiae* that is a D-alanine-activating enzyme (Accession No. NP_688780.1).

A Gapped BlastP amino acid sequence alignment showed that SEQ ID NO:150 (412 amino acids) has about 70% identity from amino acids 6-412 with a protein from *Lactobacillus gasseri* that is a predicted membrane protein involved in D-alanine export (Accession No. ZP_00046844.1), about 70% identity from amino acids 6-412 with a protein from *Lactobacillus johnsonii* that is a DltB protein (Accession No. NP_965762.1), about 58% identity from amino acids 6-410 with a protein from *Lactobacillus plantarum* that is a D-alanyl transfer protein (DltB) (Accession No. NP_785545.1), about 55% identity from amino acids 4-409 with a protein from *Enterococcus faecalis* that is a basic membrane protein (DltB) (Accession No. NP_816377.1), and about 51% identity from amino acids 6-409 with a protein from *Leuconostoc mesenteroides* subsp. *mesenteroides* that is a predicted membrane protein involved in D-alanine export (Accession No. ZP_00064054.1).

A Gapped BlastP amino acid sequence alignment showed that SEQ ID NO:152 (79 amino acids) has about 81% identity from amino acids 1-79 with a protein from *Lactobacillus johnsonii* that is a D-alanyl carrier protein (Accession No. NP_965761.1), about 79% identity from amino acids 1-79 with a protein from *Lactobacillus gasseri* that is an acyl carrier protein (Accession No. ZP_00046845.1), about 63% identity from amino acids 1-73 with a protein from *Leuconostoc mesenteroides* subsp. *mesenteroides* that is an acyl carrier protein (Accession No. ZP_00064053.1), about 67% identity from amino acids 2-77 with a protein from *Lactobacillus plantarum* that is a D-alanyl carrier protein (DltC) (Accession No. NP_785544.1), and about 64% identity from amino acids 2-77 with a protein from *Lactobacillus plantarum* that is a D-alanyl carrier protein (DltC) (Accession No. NP_785028.1).

A Gapped BlastP amino acid sequence alignment showed that SEQ ID NO:154 (428 amino acids) has about 58% identity from amino acids 1-428 with a protein from *Lactobacillus johnsonii* that is a DltD precursor (Accession No. NP_965760.1), about 58% identity from amino acids 1-428 with a protein from *Lactobacillus gasseri* that is a protein involved in D-alanine esterification of lipoteichoic acid and wall teichoic acid (D-alanine transfer protein) (Accession No. ZP_00046846.1), about 50% identity from amino acids 1-409 with a protein from *Lactobacillus plantarum* that is a D-alanyl transfer protein DltD (Accession No. NP_785543.1), about 46% identity from amino acids 1-410 with a protein from *Leuconostoc mesenteroides* subsp. *mesenteroides* that is a protein involved in D-alanine esterification of lipoteichoic acid and wall teichoic acid (D-alanine transfer protein) (Accession No. ZP_00064052.1), and about 45% identity from amino acids 5-408 with a protein from *Streptococcus mutans* that is homologous to an extramembranal protein (DltD) (Accession No. NP_722019.1).

A Gapped BlastP amino acid sequence alignment showed that SEQ ID NO:156 (477 amino acids) has about 74% identity from amino acids 1-473 with a hypothetical protein from *Lactobacillus johnsonii* (Accession No. NP_964890.1), about 74% identity from amino acids 1-474 with a protein from *Lactobacillus gasseri* that is a membrane protein involved in the export of O-antigen and teichoic acid (Accession No. ZP_00045854.1), about 46% identity from amino acids 1-470 with a protein from *Streptococcus thermophilus* that is a cpsU protein (Accession No. gb|AAM93406.1), about 46% identity from amino acids 1-470 with a protein from *Streptococcus thermophilus* that is an EpsI protein (Accession No. gb|AAK61904.1), and about 46% identity from amino acids 1-470 with a protein from *Streptococcus thermophilus* that is an EpsU protein (Accession No. emb|CAB52225.1).

A Gapped BlastP amino acid sequence alignment showed that SEQ ID NO:158 (174 amino acids) has about 83% identity from amino acids 1-174 with a protein from *Lactobacillus gasseri* that is a UDP-galactopyranose mutase (Accession No. ZP_00045853.1), about 83% identity from amino acids 1-172 with a protein from *Lactobacillus johnsonii* that is a UDP-galactopyranose mutase (Accession No. NP_964888.1), about 74% identity from amino acids 1-169 with a protein from *Lactobacillus plantarum* that is a UDP-galactopyranose mutase (Accession No. NP_784842.1), about 69% identity from amino acids 1-172 with a protein from *Lactobacillus plantarum* that is a UDP-galactopyranose mutase (Accession No. NP_784882.1), and about 63% identity from amino acids 1-172 with a protein from *Streptococcus thermophilus* that is an EpsJ protein (Accession No. gb|AAK61905.1).

A Gapped BlastP amino acid sequence alignment showed that SEQ ID NO:160 (133 amino acids) has about 88% identity from amino acids 2-133 with a protein from *Lactobacillus johnsonii* that is a UDP-galactopyranose mutase (Accession No. NP_964888.1), about 79% identity from amino acids 4-133 with a protein from *Lactobacillus plantarum* that is a UDP-galactopyranose mutase (Accession No. NP_784842.1), about 78% identity from amino acids 4-133 with a protein from *Lactobacillus plantarum* that is a UDP-galactopyranose mutase (Accession No. NP_784882.1), about 73% identity from amino acids 1-133 with a protein from *Streptococcus pneumoniae* that is a Glf-like protein (Accession No. gb|AAL68431.1), and about 70% identity from amino acids 1-133 with a protein from *Streptococcus thermophilus* that is an EpsJ protein (Accession No. gb|AAK61905.1).

A Gapped BlastP amino acid sequence alignment showed that SEQ ID NO:162 (431 amino acids) has about 22% identity from amino acids 1-375 with a protein from *Streptococcus pneumoniae* that is homologous to a polysaccharide polymerase (Accession No. gb|AAC44966.1), about 22% identity from amino acids 1-368 with a protein from *Streptococcus pneumoniae* that is a polysaccharide polymerase (Cps19aI) (Accession No. gb|AAC78671.1), about 24% identity from amino acids 4-376 with a protein from *Streptococcus pneumoniae* that is a Wzy protein (Accession No. gb|AAK20689.1), about 24% identity from amino acids 4-376 with a protein from *Streptococcus pneumoniae* that is homologous to a polysaccharide polymerase (Cps6aI) (Accession No. gb|AAL68424.1), and about 24% identity from amino acids 4-376 with a protein from *Streptococcus pneumoniae* that is homologous to a polysaccharide polymerase (Cps6aI) (Accession No. gb|AAL82786.1).

A Gapped BlastP amino acid sequence alignment showed that SEQ ID NO:164 (346 amino acids) has about 35% identity from amino acids 35-251 with a protein from *Streptococcus pneumoniae* that is a glycosyltransferase (Accession Nos. emb|CAAO7401.1; AJ006986), about 32% identity from amino acids 36-305 with a protein from *Streptococcus pneumoniae* that is homologous to a glycosyltransferase (Accession Nos. emb|CAB59291.1; AJ131984), about 33% identity from amino acids 4-272 with a protein from *Clostridium acetobutylicum* that is a glycosyltransferase involved in cell wall biogenesis (Accession Nos. NP_348116.1; NC_003030), about 31% identity from amino acids 4-254 with a protein from *Bifidobacterium longum* that is homologous to a glycosyltransferase (Accession No. NP_695639.1), and about 31% identity from amino acids 4-254 with a protein from *Bifidobacterium longum* that is a glycosyltransferase involved in cell wall biogenesis (Accession No. ZP_00120907.1).

A Gapped BlastP amino acid sequence alignment showed that SEQ ID NO:166 (218 amino acids) has about 29% identity from amino acids 8-151 with an environmental sequence (Accession No. gb|EAF15712.1), about 26% identity from amino acids 38-139 with a hypothetical protein from *Helicobacter hepaticus* (Accession No. NP_860377.1), about 24% identity from amino acids 13-166 with an environmental sequence (Accession No. gb|EAB88932.1), about 27% identity from amino acids 51-155 with an environmental sequence (Accession No. gb|EAD88260.1), and about 24% identity from amino acids 2-167 with an environmental sequence (Accession No. gb|EAF01752.1).

A Gapped BlastP amino acid sequence alignment showed that SEQ ID NO:168 (173 amino acids) has about 29% identity from amino acids 30-108 with an environmental sequence (Accession No. gb|EAJ18143.1), about 29% identity from amino acids 30-108 with an environmental sequence (Accession No. gb|EAK67508.1), about 23% identity from amino acids 8-134 with an environmental sequence (Accession No. gb|EAD63991.1), about 23% identity from amino acids 38-173 with a protein from *Arabidopsis thaliana* that is an F-box family protein (Accession No. NP_178986.1), and about 25% identity from amino acids 47-155 with a protein from *Photorhabdus luminescens* subsp. *laumondii* that is a maltodextrin phosphorylase (Accession No. NP_927823.1).

A Gapped BlastP amino acid sequence alignment showed that SEQ ID NO:170 (293 amino acids) has about 39% identity from amino acids 3-293 with a hypothetical protein from *Lactobacillus johnsonii* (Accession No. NP_964886.1), about 38% identity from amino acids 5-293 with a protein from Oenococcus oeni that is homologous to a glycosyltransferase (Accession No. ZP_00069921.1), about 36% identity from amino acids 3-290 with a protein from *Leuconostoc mesenteroides* subsp. *mesenteroides* that is homologous to a glycosyltransferase (Accession No. ZP_00064030.1), about 33% identity from amino acids 4-292 with a protein from *Thermoanaerobacterium thermosaccharolyticum* that is homologous to a glycosyltransferase (Accession No. gb|AAR85515.1), and about 32% identity from amino acids 4-265 with a hypothetical protein from *Pyrococcus horikoshii* (Accession No. NP_142407.1).

A Gapped BlastP amino acid sequence alignment showed that SEQ ID NO:172 (257 amino acids) has about 75% identity from amino acids 1-257 with a hypothetical protein from *Lactobacillus johnsonii* (Accession No. NP_964882.1), about 49% identity from amino acids 1-257 with a protein from *Lactobacillus plantarum* that is a polysaccharide biosynthesis protein (Accession No. NP_784889.1), about 51% identity from amino acids 1-249 with a protein from Lactobacillus plantarum that is a glycosyltransferase (Accession No. NP_784846.1), about 44% identity from amino acids 1-249 with a hypothetical protein from Oenococcus oeni (Accession No. ZP_00069922.1), and about 46% identity from amino acids 2-228 with a protein from *Streptococcus* thermophilus that is an EpsF protein (Accession No. gb|AAK61900.1).

A Gapped BlastP amino acid sequence alignment showed that SEQ ID NO:174 (217 amino acids) has about 73% identity from amino acids 1-217 with a protein from *Lactobacillus gasseri* that is a sugar transferase involved in lipopolysaccharide synthesis (Accession No. ZP_00045843.1), about 71% identity from amino acids 1-217 with a protein from *Lactobacillus johnsonii* that is an undecaprenyl-phosphate galactosephosphotransferase (Accession No. NP_964881.1), about 70% identity from amino acids 9-215 with a protein from *Lactobacillus delbrueckii* subsp. *bulgaricus* that is a phospho-glucosyltransferase (EpsE) (Accession No. gb|AAG44709.1), about 66% identity from amino acids 18-217 with a protein from *Lactobacillus rhamnosus* that is homologous to an undecaprenyl-phosphate glycosyl-1-phosphate transferase (Accession No. gb|AAK63832.1), and about 60% identity from amino acids 7-217 with a protein from *Lactobacillus plantarum* that is priming glycosyltransferase (Accession No. NP_784894.1).

A Gapped BlastP amino acid sequence alignment showed that SEQ ID NO:176 (256 amino acids) has about 68% identity from amino acids 1-255 with a protein from *Lactobacillus delbrueckii* subsp. *bulgaricus* that is an EpsD protein (Accession Nos. gb|AAG44708.1; AF267127), about 67% identity from amino acids 1-256 with a protein from *Lactobacillus gasseri* that is a capsular polysaccharide biosynthesis protein (Accession No. ZP_00045842.1), about 66% identity from amino acids 1-256 with a hypothetical protein from *Lactobacillus johnsonii* (Accession No. NP_964880.1), about 57% identity from amino acids 3-250 with a protein from *Lactobacillus* rhamnosus that is an EpsB protein (Accession No. gb|AAK64289.1), and about 45% identity from amino acids 3-256 with a protein from *Lactobacillus plantarum* that is an exopolysaccharide biosynthesis protein (Accession No. NP_784865.1).

A Gapped BlastP amino acid sequence alignment showed that SEQ ID NO:178 (260 amino acids) has about 66% identity from amino acids 5-225 with a protein from *Lactobacillus johnsonii* that is homologous to a tyrosine-protein kinase (Accession No. NP_964879.1), about 65% identity from amino acids 5-225 with a protein from *Lactobacillus gasseri* that is an ATPase involved in chromosome partitioning (Accession No. ZP_00045840.1), about 57% identity from amino acids 1-228 with a protein from *Lactobacillus delbrueckii* subsp. *bulgaricus* that is an EpsC protein (Accession No. gb|AAG44707.1), about 51% identity from amino acids 1-226 with a protein from *Leuconostoc mesenteroides* subsp. *mesenteroides* that is an ATPase involved in chromosome partitioning (Accession No. ZP_00063784.1), and about 46% identity from amino acids 5-230 with a protein from *Oceanobacillus iheyensis* that is a capsular polysaccharide biosynthesis protein (Accession No. NP_693822.1).

A Gapped BlastP amino acid sequence alignment showed that SEQ ID NO:180 (291 amino acids) has about 51% identity from amino acids 1-288 with a hypothetical protein from *Lactobacillus johnsonii* (Accession No. NP_964878.1), about 50% identity from amino acids 2-289 with a protein from *Lactobacillus delbrueckii* subsp. *bulgaricus* that is an EpsB protein (Accession No. gb|AAG44706.1), about 51% identity from amino acids 74-291 with a protein from *Lactobacillus gasseri* that is a capsular polysaccharide biosynthesis protein (Accession No. ZP_00045839.1), about 35% identity from amino acids 9-279 with a protein from *Leuconostoc mesenteroides* subsp. *mesenteroides* that is a capsular polysaccharide biosynthesis protein (Accession No. ZP_00063785.1), and about 31% identity from amino acids 8-284 with a protein from *Lactobacillus plantarum* that is an exopolysaccharide biosynthesis protein (Accession No. NP_784863.1).

A Gapped BlastP amino acid sequence alignment showed that SEQ ID NO:182 (351 amino acids) has about 52% identity from amino acids 45-340 with a protein from *Lactobacillus delbrueckii* subsp. *bulgaricus* that is an EpsA protein (Accession Nos. gb|AAG44705.1; AF267127), about 51% identity from amino acids 26-335 with a hypothetical protein from *Lactobacillus johnsonii* (Accession No. NP_964877.1), about 43% identity from amino acids 58-335 with a protein from *Lactobacillus plantarum* that is a transcription regulator (Accession No. NP_784704.1), about 37% identity from amino acids 59-335 with a protein from *Leuconostoc mesenteroides* subsp. *mesenteroides* that is a transcriptional regulator (Accession No. ZP_00063495.1), and about 37% identity from amino acids 26-335 with a protein from *Leuconostoc mesenteroides* subsp. *mesenteroides* that is a transcriptional regulator (Accession No. ZP_00063643.1).

A Gapped BlastP amino acid sequence alignment showed that SEQ ID NO:184 (421 amino acids) has about 76% identity from amino acids 1-417 with a protein from *Lactobacillus gasseri* that is a GTPase (Accession No. ZP_00046671.1), about 76% identity from amino acids 1-417 with a hypothetical protein from *Lactobacillus johnsonii* (Accession No. NP_965656.1), about 51% identity from amino acids 10-421 with a protein from *Listeria monocytogenes* that is homologous to an ATP/GTP-binding protein (Accession No. NP_464289.1), about 51% identity from amino acids 13-421 with a protein from *Listeria innocua* that is homologous to an ATP/GTP-binding protein (Accession No. NP_470098.1), and about 48% identity from amino acids 4-421 with a protein from *Lactobacillus plantarum* that is a GTPase (Accession No. NP_784620.1).

A Gapped BlastP amino acid sequence alignment showed that SEQ ID NO:186 (336 amino acids) has about 41% identity from amino acids 25-331 with a hypothetical protein from *Lactobacillus johnsonii* (Accession No. NP_964123.1), about 39% identity from amino acids 2-331 with a hypothetical protein from *Lactobacillus gasseri* (Accession No. ZP_00047037.1), about 20% identity from amino acids 6-310 with a hypothetical protein from *Clostridium thermocellum* (Accession No. ZP_00059706.1), about 45% identity from amino acids 162-194 with an environmental sequence (Accession No. gb|EAD87497.1), and about 24% identity from amino acids 215-324 with an environmental sequence (Accession No. gb|EAB36127.1).

A Gapped BlastP amino acid sequence alignment showed that SEQ ID NO:188 (1382 amino acids) has about 24% identity from amino acids 132-1035 with a hypothetical protein from *Enterococcus faecalis* (Accession No. NP_815907.1), about 27% identity from amino acids 456-931 with a protein from *Lactobacillus plantarum* that is homologous to a cell surface protein (Accession No. NP_786384.1), about 31% identity from amino acids 491-925 with a protein from *Vibrio vulnificus* that is a membrane associated lipoprotein precursor (Accession No. NP_935020.1), about 28% identity from amino acids 408-926 with a hypothetical protein from *Helicobacter hepaticus* (Accession No. NP_859581.1), and about 23% identity from amino acids 24-795 with a hypothetical protein from *Lactobacillus johnsonii* (Accession No. NP_964510.1).

A Gapped BlastP amino acid sequence alignment showed that SEQ ID NO:190 (250 amino acids) has about 52% identity from amino acids 126-249 with a protein from *Lactobacillus gasseri* that is a cell wall-associated hydrolase (invasion-associated protein) (Accession No. ZP_00046669.1), about 50% identity from amino acids 126-249 with a hypothetical protein from *Lactobacillus johnsonii* (Accession No. NP_965658.1), about 54% identity from amino acids 131-249 with a protein from *Clostridium acetobutylicum* that has an N-terminal domain intergin-like repeat and a c-terminal cell wall-associated hydrolase domain (Accession No. NP_349545.1), about 46% identity from amino acids 126-250 with a protein from *Oenococcus oeni* that is a cell wall-associated hydrolase (invasion-associated protein) (Accession No. ZP_00070605.1), and about 33% identity from amino acids 72-246 with a protein from *Lactobacillus plantarum* that is homologous to an extracellular protein, gamma-D-glutamate-meso-diaminopimelate muropeptidase (Accession No. NP_785666.1).

A Gapped BlastP amino acid sequence alignment showed that SEQ ID NO:194 (262 amino acids) has about 54% identity from amino acids 145-260 with a protein from *Lactobacillus gasseri* that is a cell wall-associated hydrolase (invasion-associated protein) (Accession No. ZP_00046669.1), about 51% identity from amino acids 145-260 with a hypothetical protein from *Lactobacillus johnsonii* (Accession No. NP_965658.1), about 53% identity from amino acids 143-261 with a conserved hypothetical protein from *Clostridium perfringens* (Accession No. NP_561194.1), about 50% identity from amino acids 145-261 with a protein from *Oenococcus oeni* that is a cell wall-associated hydrolase (invasion-associated protein) (Accession No. ZP_00070605.1), and about 51% identity from amino acids 143-260 with a protein from *Clostridium acetobutylicum* that is a cell wall-associated hydrolase (Accession No. NP_346949.1).

A Gapped BlastP amino acid sequence alignment showed that SEQ ID NO:196 (184 amino acids) has about 43% identity from amino acids 48-182 with a protein from *Lactobacillus gasseri* that is a cell wall-associated hydrolase (invasion-associated protein) (Accession No. ZP_00046669.1), about 43% identity from amino acids 47-182 with a hypothetical protein from *Lactobacillus johnsonii* (Accession No. NP_965658.1), about 48% identity from amino acids 66-182 with a protein from *Enterococcus faecium* that is a surface antigen (Accession No. ZP_00036908.1), about 48% identity from amino acids 66-182 with a protein from *Enterococcus faecium* that is homologous to a glycosidase (GlyA) (Accession No. gb|AAK72496.1), and about 41% identity from amino acids 46-171 with a hypothetical protein from *Lactococcus lactis* subsp. *lactis* (Accession No. NP_267092.1).

A Gapped BlastP amino acid sequence alignment showed that SEQ ID NO:198 (149 amino acids) has about 52% identity from amino acids 1-146 with a protein from *Lactobacillus gasseri* that is a guanylate kinase (Accession No. ZP_00046668.1), about 54% identity from amino acids 1-145 with a protein from *Lactobacillus johnsonii* that is a guanylate kinase (Accession No. NP_965659.1), about 43% identity from amino acids 1-148 with a protein from *Lactobacillus plantarum* that is a guanylate kinase (Accession No. NP_784598.1), about 40% identity from amino acids 1-145 with a protein from *Leuconostoc mesenteroides* subsp. *mesenteroides* that is a guanylate kinase (Accession No. ZP_00063506.1), and about 38% identity from amino acids 1-145 with a protein from *Oenococcus oeni* that is a guanylate kinase (Accession No. ZP_00070365.1).

A Gapped BlastP amino acid sequence alignment showed that SEQ ID NO:200 (99 amino acids) has about 71% identity from amino acids 1-80 with a hypothetical protein from *Lactobacillus gasseri* (Accession No. ZP_00046667.1), about 70% identity from amino acids 1-80 with a hypothetical protein from *Lactobacillus johnsonii* (Accession No. NP_965660.1), about 40% identity from amino acids 8-69 with a hypothetical protein from *Leuconostoc mesenteroides* subsp. *mesenteroides* (Accession No. ZP_00063600.1), about 33% identity from amino acids 5-75 with a protein from *Lactobacillus plantarum* (Accession No. NP_785013.1), and about 39% identity from amino acids 4-69 with a protein from *Lactobacillus plantarum* (Accession No. NP_786559.1).

A Gapped BlastP amino acid sequence alignment showed that SEQ ID NO:202 (503 amino acids) has about 40% identity from amino acids 1-497 with a hypothetical protein from *Lactobacillus johnsonii* (Accession No. NP_965661.1), about 40% identity from amino acids 214-502 with a hypothetical protein from *Lactobacillus gasseri* (Accession No. ZP_00046666.1), about 22% identity from amino acids 105-477 with a protein from *Bacillus cereus* that is homologous to a membrane protein (Accession No. NP_977301.1), about 19% identity from amino acids 4-497 with a hypothetical protein from *Bacillus anthracis* (Accession No. NP_653890.1), and about 19% identity from amino acids 4-497 with a protein from *Bacillus anthracis* that is homologous to a membrane protein (Accession No. NP_847818.1).

A Gapped BlastP amino acid sequence alignment showed that SEQ ID NO:204 (206 amino acids) has about 43% identity from amino acids 4-205 with a hypothetical protein from *Lactobacillus johnsonii* (Accession No. NP_965662.1), about 42% identity from amino acids 4-205 with a hypothetical protein from *Lactobacillus gasseri* (Accession No. ZP_00046665.1), about 33% identity from amino acids 41-203 with a protein from *Lactobacillus plantarum* (Accession No. NP_786135.1), about 26% identity from amino acids 71-177 with a hypothetical protein from *Plasmodium falciparum* (Accession No. NP_701622.1), and about 27% identity from amino acids 62-145 with an environmental sequence (Accession No. gb|EAH10085.1).

A Gapped BlastP amino acid sequence alignment showed that SEQ ID NO:206 (148 amino acids) has about 60% identity from amino acids 1-147 with a protein from *Lactobacillus johnsonii* that is an NrdI protein (Accession No. NP_965663.1), about 60% identity from amino acids 1-147 with a protein from *Lactobacillus gasseri* that is a protein involved in ribonucleotide reduction (Accession No. ZP_00046664.1), about 38% identity from amino acids 4-123 with a protein from *Enterococcus faecalis* that is a NrdI protein (Accession No. NP_814256.1), about 33% identity from amino acids 4-124 with a protein from *Lactococcus lactis* that is a NrdI protein (Accession No. sp|Q48709|NRDI_LACLC), and about 33% identity from amino acids 4-124 with a protein from *Lactococcus lactis* subsp. *lactis* that is a ribonucleotide reductase (Accession No. NP_267132.1).

A Gapped BlastP amino acid sequence alignment showed that SEQ ID NO:208 (311 amino acids) has about 53% identity from amino acids 3-310 with a hypothetical protein from *Lactobacillus johnsonii* (Accession No. NP_965664.1), about 53% identity from amino acids 3-311 with a protein from *Lactobacillus gasseri* that is a ribonucleotide reductase, beta subunit (Accession No. ZP_00046663.1), about 42% identity from amino acids 5-296 with a protein from *Streptococcus pyogenes* that is a ribonucleotide diphosphate reductase small subunit (Accession No. NP_607484.1), about 42% identity from amino acids 5-296 with a protein from *Streptococcus pyogenes* that is a ribonucleotide diphosphate reductase small subunit (Accession No. NP_269482.1), and about 42% identity from amino acids 5-296 with a protein from *Streptococcus agalactiae* that is a ribonucleoside-diphosphate reductase 2, beta subunit (Accession No. NP_687833.1).

A Gapped BlastP amino acid sequence alignment showed that SEQ ID NO:210 (177 amino acids) has about 58% identity from amino acids 1-152 with a hypothetical protein from *Lactobacillus gasseri* (Accession No. ZP_00046662.1), about 57% identity from amino acids 1-152 with a hypothetical protein from *Lactobacillus johnsonii* (Accession No. NP_965665.1), about 33% identity from amino acids 1-132 with a protein from *Lactobacillus plantarum* (Accession No. NP_786047.1), about 29% identity from amino acids 23-144 with a hypothetical protein from *Pyrococcus horikoshii* (Accession No. NP_142266.1), and about 33% identity from amino acids 1-67 with an environmental sequence (Accession No. gb|EAC37753.1).

A Gapped BlastP amino acid sequence alignment showed that SEQ ID NO:212 (240 amino acids) has about 63% identity from amino acids 7-240 with a protein from *Lactobacillus gasseri* (Accession No. ZP_00047171.1), about 66% identity from amino acids 20-240 with a hypothetical protein from *Lactobacillus johnsonii* (Accession No. NP_965638.1), about 41% identity from amino acids 7-239 with a protein from *Lactobacillus plantarum* (Accession No. NP_786183.1), about 44% identity from amino acids 51-239 with a protein from *Listeria monocytogenes* that is homologous to a YvpB protein (Accession No. NP_464251.1), and about 42% identity from amino acids 52-240 with a protein from *Bacillus subtilis* that is a YvpB protein (Accession No. NP_391374.1).

A Gapped BlastP amino acid sequence alignment showed that SEQ ID NO:214 (105 amino acids) has about 60% identity from amino acids 4-105 with a hypothetical protein from *Lactobacillus johnsonii* (Accession No. NP_964999.1), about 50% identity from amino acids 4-104 with a hypothetical protein from *Lactococcus lactis* subsp. *lactis* (Accession No. NP_267039.1), about 50% identity from amino acids 3-104 with a protein from *Enterococcus faecium* that is homologous to a metal-sulfur cluster biosynthetic enzyme (Accession No. ZP_00036555.1), about 46% identity from amino acids 4-104 with a conserved hypothetical protein from *Enterococcus faecalis* (Accession No. NP_815231.1), and about 56% identity from amino acids 16-105 with a protein from *Lactobacillus plantarum* (Accession No. NP_784773.1).

A Gapped BlastP amino acid sequence alignment showed that SEQ ID NO:216 (98 amino acids) has about 81% identity from amino acids 3-98 with a hypothetical protein from *Lactobacillus johnsonii* (Accession No. NP_964998.1), about 72% identity from amino acids 3-98 with a protein from *Lactobacillus plantarum* that is homologous to an ABC transporter component, iron regulated (Accession No. NP_785081.1), about 67% identity from amino acids 3-98 with a protein from *Oenococcus oeni* that is an ABC-type transport system involved in Fe-S cluster assembly, permease component (Accession No. ZP_00069298.1), about 64% identity from amino acids 4-98 with a conserved hypothetical protein from *Streptococcus pneumoniae* (Accession No. NP_358369.1), and about 64% identity from amino acids 4-98 with a conserved hypothetical intein-containing protein from *Streptococcus pneumoniae* (Accession No. NP_345358.1).

A Gapped BlastP amino acid sequence alignment showed that SEQ ID NO:218 (76 amino acids) has about 80% identity from amino acids 1-73 with a protein from *Lactobacillus johnsonii* that is an ABC transporter ATPase component (Accession No. NP_964994.1), about 73% identity from amino acids 1-73 with a protein from *Lactobacillus plantarum* that is an ABC transporter, ATP-binding protein (Accession No. NP_785077.1), about 71% identity from amino acids 1-73 with a protein from *Streptococcus mutans* that is homologous to an ABC transporter, ATP-binding protein (Accession No. NP_720711.1), about 65% identity from amino acids 1-73 with a protein from *Enterococcus faecium* that is an ABC-type transport system involved in Fe-S cluster assembly, ATPase component (Accession No. ZP_00037285.1), and about 69% identity from amino acids 1-72 with a protein from *Streptococcus pneumoniae* that is an ABC transporter, ATP-binding protein (Accession No. NP_345354.1).

A Gapped BlastP amino acid sequence alignment showed that SEQ ID NO:220 (52 amino acids) has about 32% identity from amino acids 5-47 with a hypothetical protein from *Plasmodium falciparum* (Accession No. NP_700844.1).

A Gapped BlastP amino acid sequence alignment showed that SEQ ID NO:222 (161 amino acids) has about 59% identity from amino acids 1-146 with a protein from *Lactobacillus gasseri* (Accession No. ZP_00046659.1), about 60% identity from amino acids 1-146 with a hypothetical protein from *Lactobacillus johnsonii* (Accession No. NP_965668.1), about 44% identity from amino acids 7-151 with a protein from *Listeria innocua* (Accession No. NP_469929.1), about 39% identity from amino acids 7-161 with a protein from *Enterococcus faecalis* that is homologous to a membrane protein (Accession No. NP_814929.1), and about 40% identity from amino acids 11-137 with a protein from *Lactobacillus plantarum* that is an integral membrane protein (Accession No. NP_784703.1).

A Gapped BlastP amino acid sequence alignment showed that SEQ ID NO:224 (256 amino acids) has about 64% identity from amino acids 12-235 with a protein from *Lactobacillus gasseri* (Accession No. ZP_00046658.1), about 63% identity from amino acids 12-235 with a hypothetical protein from *Lactobacillus johnsonii* (Accession No. NP_965669.1), about 48% identity from amino acids 12-216 with a protein from *Lactobacillus sakei* that is a LabL protein (Accession No. gb|AAL00959.1), about 45% identity from amino acids 13-235 with a conserved membrane protein from *Listeria innocua* (Accession No. NP_469930.1), and about 45% identity from amino acids 13-235 with a conserved membrane protein from *Listeria monocytogenes* (Accession No. NP_464106.1).

A Gapped BlastP amino acid sequence alignment showed that SEQ ID NO:226 (513 amino acids) has about 81% identity from amino acids 1-513 with a protein from *Lactobacillus gasseri* that is an ATPase component of ABC transporters with duplicated ATPase domains (Accession No. ZP_00046657.1), about 81% identity from amino acids 1-513 with a protein from *Lactobacillus johnsonii* that is an ABC transporter ATPase component (Accession No. NP_965670.1), about 52% identity from amino acids 1-513 with a protein from *Lactobacillus plantarum* that is an ABC transporter, ATP-binding protein (Accession No. NP_785961.1), about 52% identity from amino acids 1-512 with a protein from *Enterococcus faecalis* that is an ABC transporter, ATP-binding protein (Accession No. NP_815740.1), and about 49% identity from amino acids 1-513 with a protein from Oenococcus oeni that is an ATPase component of ABC transporters with duplicated ATPase domains (Accession No. ZP_00070366.1).

A Gapped BlastP amino acid sequence alignment showed that SEQ ID NO:228 (124 amino acids) has about 50% identity from amino acids 3-124 with a hypothetical protein from *Lactobacillus johnsonii* (Accession No. NP_965671.1), about 51% identity from amino acids 3-121 with a hypothetical protein from *Lactobacillus gasseri* (Accession No. ZP_00046656.1), and about 48% identity from amino acids 53-81 with a hypothetical protein from *Pyrococcus furiosus* (Accession No. NP_578913.1).

A Gapped BlastP amino acid sequence alignment showed that SEQ ID NO:230 (73 amino acids) has about 39% identity from amino acids 8-58 with a protein from *Leuconostoc mesenteroides* subsp. *mesenteroides* that is an acetyltransferase (Accession No. ZP_00063180.1), about 36% identity from amino acids 7-58 with a protein from *Oenococcus oeni* that is an acetyltransferase (Accession No. ZP_00069032.1), about 36% identity from amino acids 7-56 with a hypothetical protein from *Lactobacillus johnsonii* (Accession No. NP_965082.1), about 36% identity from amino acids 15-55 with an environmental sequence (Accession No. gb|EAI00330.1), and about 37% identity from amino acids 12-54 with a protein from *Bacillus anthracis* that is an acetyltransferase in the GNAT family (Accession No. NP_658716.1).

A Gapped BlastP amino acid sequence alignment showed that SEQ ID NO:232 (424 amino acids) has about 58% identity from amino acids 8-375 with a hypothetical protein from *Lactobacillus johnsonii* (Accession No. NP_965673.1), about 58% identity from amino acids 8-375 with a protein from *Lactobacillus gasseri* that is a transcriptional regulator (Accession No. ZP_00046655.1), about 41% identity from amino acids 42-383 with a hypothetical protein from *Lactobacillus johnsonii* (Accession No. NP_964188.1), about 42% identity from amino acids 42-370 with a protein from *Lactobacillus gasseri* that is a transcriptional regulator (Accession No. ZP_00047236.1), and about 46% identity from amino acids 78-350 with a protein from *Lactobacillus plantarum* that is a transcription regulator (Accession No. NP_784105.1).

A Gapped BlastP amino acid sequence alignment showed that SEQ ID NO:234 (538 amino acids) has about 30% identity from amino acids 5-527 with a protein from *Lactobacillus gasseri* that is a membrane protein involved in the export of O-antigen and teichoic acid (Accession No. ZP_00047298.1), about 29% identity from amino acids 5-527 with a protein from *Lactobacillus johnsonii* that is an export protein for polysaccharides and teichoic acids (Accession No. NP_964533.1), about 31% identity from amino acids 1-457 with a protein from *Enterococcus faecalis* that is a polysaccharide biosynthesis family protein (Accession No. NP_814328.1), about 33% identity from amino acids 3-450 with a protein from *Enterococcus faecalis* that is a polysaccharide biosynthesis family protein (Accession No. NP_814421.1), and 28% identity from amino acids 3-526 with a protein from *Streptococcus mutans* that is homologous to a membrane protein (Accession No. NP_722009.1).

A Gapped BlastP amino acid sequence alignment showed that SEQ ID NO:236 (271 amino acids) has about 58% identity from amino acids 1-271 with a hypothetical protein from *Lactobacillus johnsonii* (Accession No. NP_964116.1), about 58% identity from amino acids 1-271 with a protein from *Lactobacillus gasseri* that is a glycosyltransferase involved in cell wall biogenesis (Accession No. ZP_00047045.1), about 31% identity from amino acids 7-234 with a protein from *Bacillus cereus* that is a glycosyltransferase (Accession No. NP_834930.1), about 28% identity from amino acids 2-250 with a protein from *Streptococcus thermophilus* that is an EpsV protein (Accession No. emb|CAB52224.1), and 31% identity from amino acids 2-222 with a protein from *Lactobacillus plantarum* that is a glycosyltransferase (Accession No. NP_786160.1).

A Gapped BlastP amino acid sequence alignment showed that SEQ ID NO:238 (476 amino acids) has about 75% identity from amino acids 1-475 with a protein from *Lactobacillus gasseri* that is a membrane protein involved in the export of O-antigen and teichoic acid (Accession No. ZP_00047223.1), about 74% identity from amino acids 1-475 with a hypothetical protein from *Lactobacillus johnsonii* (Accession No. NP_965532.1), about 30% identity from amino acids 7-460 with a protein from *Streptococcus thermophilus* that is a cpsU protein (Accession No. gb|AAM93406.1), about 30% identity from amino acids 7-460 with a protein from *Streptococcus thermophilus* that is an EpsU protein (Accession No. emb|CAB52225.1), and 30% identity from amino acids 7-460 with a protein from *Streptococcus thermophilus* that is an EpsI protein (Accession No. gb|AAK61904.1).

A Gapped BlastP amino acid sequence alignment showed that SEQ ID NO:240 (367 amino acids) has about 54% identity from amino acids 3-364 with a protein from *Lactobacillus gasseri* that is a transcriptional regulator (Accession No. ZP_00047236.1), about 53% identity from amino acids 3-364 with a hypothetical protein from *Lactobacillus johnsonii* (Accession No. NP_964188.1), about 42% identity from amino acids 22-360 with a protein from *Lactobacillus gasseri* that is a transcription regulator (Accession No. ZP_00046655.1), about 41% identity from amino acids 21-360 with a hypothetical protein from *Lactobacillus johnsonii* (Accession No. NP_965673.1), and 0.44% identity from amino acids 33-338 with a protein from *Lactobacillus plantarum* that is a transcription regulator (Accession No. NP_784704.1).

A Gapped BlastP amino acid sequence alignment showed that SEQ ID NO:242 (246 amino acids) has about 46% identity from amino acids 1-242 with a hypothetical protein from *Lactobacillus johnsonii* (Accession No. NP_965126.1), about 37% identity from amino acids 77-234 with a protein from *Clostridium thermocellum* that is a glycosyltransferase (Accession No. ZP_00060425.1), about 33% identity from amino acids 10-220 with a protein from *Helicobacter pylori* that is a type I capsular polysaccharide biosynthesis protein J (capJ) (Accession No. NP_207219.1), about 32% identity from amino acids 17-225 with a protein from *Bifidobacterium longum* that is a glycosyltransferase (Accession No. ZP_00120944.1), and 32% identity from amino acids 17-225 with a protein from *Bifidobacterium longum* that is homologous to a glycosyltransferase (Accession No. NP_696276.1).

A Gapped BlastP amino acid sequence alignment showed that SEQ ID NO:244 (380 amino acids) has about 88% identity from amino acids 1-380 with a protein from *Lactobacillus gasseri* that is a UDP-N-acetylglucosamine 2-epimerase (Accession No. ZP_00046464.1), about 84% identity from amino acids 1-379 with a protein from *Lactobacillus johnsonii* that is homologous to a UDP-N-acetylglucosamine 2-epimerase (Accession No. NP_965402.1), about 70% identity from amino acids 1-379 with a protein from *Streptococcus mutans* that is homologous to a UDP-N-acetylglucosamine 2-epimerase (Accession No. NP_721794.1), about 68% identity from amino acids 4-364 with a protein from *Lactobacillus plantarum* that is a UDP-N-acetylglucosamine 2-epimerase (Accession No. NP_784839.1), and 64% identity from amino acids 1-379 with a protein from *Listeria innocua* that is homologous to a UDP-N-acetylglucosamine 2-epimerase (Accession No. NP_472010.1).

A Gapped BlastP amino acid sequence alignment showed that SEQ ID NO:246 (399 amino acids) has about 85% identity from amino acids 7-398 with a protein from *Lactobacillus gasseri* that is a UDP-N-acetylglucosamine 2-epimerase (Accession No. ZP_00046464.1), about 84% identity from amino acids 20-398 with a protein from *Lactobacillus johnsonii* that is homologous to a UDP-N-acetylglucosamine 2-epimerase (Accession No. NP_965402.1), about 70% identity from amino acids 20-398 with a protein from *Streptococcus mutans* that is homologous to a UDP-N-acetylglucosamine 2-epimerase (Accession No. NP_721794.1), about 68% identity from amino acids 23-383 with a protein from *Lactobacillus plantarum* that is a UDP-N-acetylglucosamine 2-epimerase (Accession No. NP_784839.1), and 64% identity from amino acids 20-398 with a protein from *Listeria innocua* that is homologous to a UDP-N-acetylglucosamine 2-epimerase (Accession No. NP_472010.1).

A Gapped BlastP amino acid sequence alignment showed that SEQ ID NO:248 (232 amino acids) has about 74% identity from amino acids 1-232 with a hypothetical protein from *Lactobacillus johnsonii* (Accession No. NP_965530.1), about 74% identity from amino acids 1-232 with a protein from *Lactobacillus gasseri* that is in the mannosyltransferase OCH1 and related enzyme family (Accession No. ZP_00047224.1), about 40% identity from amino acids 1-208 with a protein from *Clostridium thermocellum* that is in the mannosyltransferase OCH1 and related enzyme family (Accession No. ZP_00060271.1), about 35% identity from amino acids 2-213 with a protein from *Lactobacillus gasseri* that is in the mannosyltransferase OCH 1 and related enzyme family (Accession No. ZP_00045846.1), and 38% identity from amino acids 1-211 with a protein from *Lactococcus lactis* subsp. *cremoris* that is an EpsQ protein (Accession No. gb|AAP32730.1).

A Gapped BlastP amino acid sequence alignment showed that SEQ ID NO:250 (387 amino acids) has about 70% identity from amino acids 1-379 with a hypothetical protein from *Lactobacillus johnsonii* (Accession No. NP_965577.1), about 77% identity from amino acids 1-315 with a protein from *Lactobacillus gasseri* that is a glycosyltransferase (Accession No. ZP_00047202.1), about 53% identity from amino acids 1-374 with a protein from *Lactobacillus plantarum* that is a glycosyltransferase (Accession No. NP_784929.1), about 49% identity from amino acids 1-386 with a protein from *Leuconostoc mesenteroides* subsp. *mesenteroides* that is a glycosyltransferase (Accession No. ZP_00063751.1), and 48% identity from amino acids 1-374 with a protein from *Enterococcus faecium* that is a glycosyltransferase (Accession No. ZP_00036762.1).

A Gapped BlastP amino acid sequence alignment showed that SEQ ID NO:252 (156 amino acids) has about 62% identity from amino acids 26-152 with a hypothetical protein from *Lactobacillus johnsonii* (Accession No. NP_964097.1), about 52% identity from amino acids 1-152 with a protein from *Lactobacillus gasseri* that is a glycosyltransferase (Accession No. ZP_00047062.1), about 56% identity from amino acids 50-152 with a protein from *Streptococcus mutans* that is homologous to a glycosyltransferase (Accession No. NP_721791.1), about 40% identity from amino acids 36-149 with a protein from *Clostridium tetani* that is an N-acetylglucosaminyltransferase (Accession No. NP_781499.1), and 37% identity from amino acids 44-152 with a protein from *Bacillus subtilis* that is homologous to a cellulose synthase (Accession No. NP_388311.1).

A Gapped BlastP amino acid sequence alignment showed that SEQ ID NO:254 (490 amino acids) has about 100% identity from amino acids 11-490 with a protein from *Lactobacillus acidophilus* that is a sucrose phosphorylase (Accession No. gb|AAO21861.1), about 69% identity from amino acids 11-490 with a protein from *Lactobacillus acidophilus* that is a sucrose phosphorylase (Accession No. gb|AAO21868.1), about 68% identity from amino acids 11-490 with a protein from *Lactobacillus johnsonii* that is a sucrose phosphorylase (Accession No. NP_964279.1), about 63% identity from amino acids 11-490 with a protein from *Streptococcus mutans* that is a sucrose phosphorylase (EC 2.4.1.7) (Accession No. pir||A27626), and 63% identity from amino acids 11-489 with a protein from *Streptococcus mutans* that is a gtfA protein (Accession No. pir||BWSOGM).

A Gapped BlastP amino acid sequence alignment showed that SEQ ID NO:256 (548 amino acids) has about 69% identity from amino acids 8-546 with a protein from *Lactobacillus gasseri* that is a membrane protein involved in the export of O-antigen and teichoic acid (Accession No. ZP_00047298.1), about 67% identity from amino acids 8-546 with a protein from *Lactobacillus johnsonii* that is an export protein for polysaccharides and teichoic acids (Accession No. NP_964533.1), about 42% identity from amino acids 5-546 with a protein from *Enterococcus faecalis* that is a polysaccharide biosynthesis family protein (Accession Nos. NP_814421.1), about 42% identity from amino acids 17-546 with a protein from *Lactobacillus plantarum* that is an integral membrane protein (Accession No. NP_784959.1), and 38% identity from amino acids 13-547 with a protein from *Streptococcus mutans* that is homologous to a membrane protein (Accession No. NP_722009.1).

A Gapped BlastP amino acid sequence alignment showed that SEQ ID NO:258 (363 amino acids) has about 64% identity from amino acids 1-363 with a hypothetical protein from *Lactobacillus johnsonii* (Accession No. NP_965541.1), about 62% identity from amino acids 1-363 with a protein from *Lactobacillus gasseri* that is a glycosyltransferase (Accession No. ZP_00047215.1), about 41% identity from amino acids 1-363 with a protein from *Bacillus anthracis* that is a glycosyltransferase, group 1 family protein (Accession No. NP_847817.1), about 40% identity from amino acids 1-363 with a protein from *Bacillus anthracis* that is a glycosyltransferase group I protein (Accession No. NP_653889.1), and 39% identity from amino acids 1-363 with a protein from *Bacillus cereus* that is a glycosyltransferase (Accession No. NP_835081.1).

A Gapped BlastP amino acid sequence alignment showed that SEQ ID NO:260 (556 amino acids) has about 74% identity from amino acids 6-555 with a protein from *Lactobacillus gasseri* that is a glycosidase (Accession No. ZP_00047085.1), about 73% identity from amino acids 6-553 with a hypothetical protein from *Lactobacillus johnsonii* (Accession No. NP_964227.1), about 50% identity from amino acids 8-553 with a protein from *Lactobacillus plantarum* that is an alpha-glucosidase (Accession No. NP_784006.1), about 35% identity from amino acids 7-556 with a protein from *Bacillus halodurans* that is an oligo-1,6-glucosidase (Accession No. NP_243769.1), and 34% identity from amino acids 9-553 with a protein from *Bacillus cereus* that is an oligo-1,6-glucosidase (oligosaccharide alpha-1,6-glucosidase) (Accession No. sp|P21332|O16G_BACCE).

A Gapped BlastP amino acid sequence alignment showed that SEQ ID NO:262 (759 amino acids) has about 75% identity from amino acids 1-757 with a hypothetical protein from *Lactobacillus johnsonii* (Accession No. NP_964589.1), about 52% identity from amino acids 1-732 with a protein from *Clostridium acetobutylicum* that is an alpha-glucosidase (Accession No. NP_347719.1), about 51% identity from amino acids 1-726 with a protein from *Thermotoga maritima* that is an alpha-xylosidase (Accession No. NP_228120.1), about 49% identity from amino acids 1-724 with a protein from *Bacillus halodurans* (Accession No. NP_242771.1), and 47% identity from amino acids 1-727 with a hypothetical protein from *Escherichia coli* (Accession No. NP_418113.1).

A Gapped BlastP amino acid sequence alignment showed that SEQ ID NO:264 (767 amino acids) has about 69% identity from amino acids 3-766 with a protein from *Lactobacillus johnsonii* that is an alpha-glucosidase (Accession No. NP_965686.1), about 69% identity from amino acids 3-766 with a protein from *Lactobacillus gasseri* that is an alpha-glucosidase (Accession No. ZP_00046641.1), about 64% identity from amino acids 5-761 with a protein from *Lactobacillus plantarum* that is an alpha-glucosidase (Accession No. NP_786738.1), about 41% identity from amino acids 15-720 with a protein from *Thermoanaerobacter tengcongensis* that is an alpha-glucosidase (Accession No. NP_621719.1), and 40% identity from amino acids 20-717 with a protein from *Bacillus thermoamyloliquefaciens* that is an alpha-glucosidase II (Accession No. sp|Q9F234|AGL2_BACTQ).

A Gapped BlastP amino acid sequence alignment showed that SEQ ID NO:266 (544 amino acids) has about 78% identity from amino acids 6-541 with a protein from *Lactobacillus gasseri* that is a glycosidase (Accession No. ZP_00047077.1), about 77% identity from amino acids 6-541 with a protein from *Lactobacillus johnsonii* that is a glucan 1,6-alpha-glucosidase (Accession No. NP_964235.1), about 63% identity from amino acids 2-542 with a protein from *Enterococcus faecium* that is a glycosidase (Accession No. ZP_00037211.1), about 62% identity from amino acids 9-542 with a protein from *Enterococcus faecalis* that is homologous to a glucan 1,6-alpha-glucosidase (Accession No. NP_815069.1), and 61% identity from amino acids 9-543 with a protein from *Streptococcus pneumoniae* that is a glucan 1,6-alpha-glucosidase (Accession No. NP_344876.1).

A Gapped BlastP amino acid sequence alignment showed that SEQ ID NO:268 (1004 amino acids) has about 48% identity from amino acids 4-1003 with a hypothetical protein from *Lactobacillus johnsonii* (Accession No. NP_964131.1), about 48% identity from amino acids 1-1003 with a protein from *Lactobacillus gasseri* that is an alpha-glucosidase (Accession No. ZP_00047030.1), about 32% identity from amino acids 12-1001 with a protein from *Enterococcus faecalis* that is a glycosyl hydrolase (Accession No. NP_815521.1), about 30% identity from amino acids 98-1000 with a protein from *Bacteroides thetaiotaomicron* that is an alpha-xylosidase (Accession No. NP_812081.1), and 25% identity from amino acids 11-995 with a hypothetical protein from *Clostridium perfringens* (Accession No. NP_561962.1).

A Gapped BlastP amino acid sequence alignment showed that SEQ ID NO:270 (570 amino acids) has about 77% identity from amino acids 17-568 with a protein from *Lactobacillus gasseri* that is a glycosidase (Accession No. ZP_00045981.1), about 77% identity from amino acids 17-568 with a protein from *Lactobacillus johnsonii* that is a trehalose-6-phosphate hydrolase (Accession No. NP_964610.1), about 66% identity from amino acids 18-566 with a protein from *Lactobacillus plantarum* that is an alpha, alpha-phosphotrehalase (Accession No. NP_784081.1), about 57% identity from amino acids 23-568 with a protein from *Streptococcus pneumoniae* that is a dextran glucosidase (Accession No. NP_359290.1), and 57% identity from amino acids 23-568 with a protein from *Streptococcus pneumoniae* that is homologous to a dextran glucosidase (DexS) (Accession No. NP_346315.1).

A Gapped BlastP amino acid sequence alignment showed that SEQ ID NO:272 (638 amino acids) has about 56% identity from amino acids 8-621 with a protein from *Streptococcus mutans* that is homologous to a 1,4-alpha-glucan branching enzyme (Accession No. NP_721883.1), about 57% identity from amino acids 8-619 with a protein from *Streptococcus agalactiae* that is a 1,4-alpha-glucan branching enzyme (Accession No. sp|Q8E5V8|GLGB_STRA3), about 57% identity from amino acids 8-619 with a protein from *Streptococcus agalactiae* that is a 1,4-alpha-glucan branching enzyme (Accession No. NP_687868.1), about 56% identity from amino acids 8-621 with a protein from *Streptococcus pneumoniae* that is a 1,4-alpha-glucan branching enzyme (Accession No. NP_345592.1), and 56% identity from amino acids 8-621 with a protein from *Streptococcus pneumoniae* that is a 1,4-alpha-glucan branching enzyme (Accession No. NP_358623.1).

A Gapped BlastP amino acid sequence alignment showed that SEQ ID NO:274 (573 amino acids) has about 76% identity from amino acids 1-572 with a protein from *Lactobacillus johnsonii* that is a maltogenic amylase or neopullulanase (Accession No. NP_964228.1), about 75% identity from amino acids 1-572 with a protein from *Lactobacillus gasseri* that is a glycosidase (Accession No. ZP_00047084.1), about 54% identity from amino acids 56-571 with a protein from *Enterococcus faecium* that is a glycosidase (Accession No. ZP_00036988.1), about 49% identity from amino acids 1-570 with a protein from *Enterococcus faecalis* that is a glycosyl hydrolase (Accession No. NP_815068.1), and 50% identity from amino acids 1-540 with a protein from *Lactococcus lactis* subsp. *lactis* that is a neopullulanase (Accession No. NP_267838.1).

A Gapped BlastP amino acid sequence alignment showed that SEQ ID NO:276 (1185 amino acids) has about 39% identity from amino acids 284-1008 with a protein from *Bacillus cereus* that is a pullulanase (Accession No. NP_832487.1), about 40% identity from amino acids 284-1008 with a protein from *Bacillus cereus* that is homologous to a pullulanase (Accession No. NP_979065.1), about 40% identity from amino acids 284-1008 with a protein from *Bacillus anthracis* that is homologous to a pullulanase (Accession No. NP_845079.1), about 41% identity from amino acids 306-1008 with a protein from *Bacillus anthracis* that is an alpha-amylase (Accession No. NP_656611.1), and 38% identity from amino acids 284-976 with a protein from *Anaerobranca horikoshii* that is a pullulanase (Accession No. gb|AAP45012.1).

A Gapped BlastP amino acid sequence alignment showed that SEQ ID NO:278 (589 amino acids) has about 42% identity from amino acids 5-548 with a protein from *Lactococcus lactis* subsp. *lactis* that is an amylopullulanase (Accession Nos. NP_266857.1; NC_002662), about 41% identity from amino acids 1-546 with a protein from *Lactobacillus plantarum* that is an alpha-amylase (Accession No. NP_783889.1), about 38% identity from amino acids 3-558 with a protein from *Clostridium perfringens* that is an amylopullulanase (Accession No. NP_560982.1), about 70% identity from amino acids 198-441 with a protein from *Lactobacillus delbrueckii* subsp. *lactis* that is a glycosyl hydrolase (Accession No. gb|AAQ06973.1), and 37% identity from amino acids 73-547 with a protein from *Desulfitobacterium hafniense* that is a glycosidase (Accession No. ZP_00100175.1).

A Gapped BlastP amino acid sequence alignment showed that SEQ ID NO:280 (435 amino acids) has about 22% identity from amino acids 78-384 with an environmental sequence (Accession No. gb|EAH69409.1), about 23% identity from amino acids 53-387 with a hypothetical protein from *Plasmodium falciparum* (Accession No. NP_701320.1), about 22% identity from amino acids 59-382 with a hypothetical protein from *Plasmodium falciparum* (Accession No. NP_701961.1), about 22% identity from amino acids 56-386 with a hypothetical protein from *Plasmodium falciparum* (Accession No. NP_473199.1), and about 24% identity from amino acids 61-336 with a protein from *Plasmodium yoelii yoelii* that is homologous to a CCAAT-box DNA binding protein subunit B (Accession No. gb|EAA22696.1).

A Gapped BlastP amino acid sequence alignment showed that SEQ ID NO:282 (382 amino acids) has about 54% identity from amino acids 1-382 with a hypothetical protein from *Lactobacillus johnsonii* (Accession No. NP_965524.1), about 60% identity from amino acids 115-382 with a protein from *Lactobacillus gasseri* that is a protein involved in sex pheromone biosynthesis (Accession No. ZP_00046368.1), about 41% identity from amino acids 1-382 with a protein from *Lactobacillus plantarum* that is a lipoprotein precursor (Accession No. NP_784816.1), about 38% identity from amino acids 53-374 with a protein from *Leuconostoc mesenteroides* subsp. *mesenteroides* that is a protein involved in sex pheromone biosynthesis (Accession No. ZP_00063694.1), and 35% identity from amino acids 1-379 with a protein from *Listeria innocua* (Accession No. NP_471203.1).

A Gapped BlastP amino acid sequence alignment showed that SEQ ID NO:284 (173 amino acids) has about 52% identity from amino acids 1-161 with a hypothetical protein from *Lactobacillus johnsonii* (Accession No. NP_964736.1), about 51% identity from amino acids 1-161 with a hypothetical protein from *Lactobacillus gasseri* (Accession No. ZP_00047405.1), about 25% identity from amino acids 21-159 with a hypothetical protein from *Oenococcus oeni* (Accession No. ZP_00010369.1), about 28% identity from amino acids 4-74 with an environmental sequence (Accession No. gb|EAF86579.1), and 24% identity from amino acids 63-160 with a protein from *Listeria innocua* that is homologous to a cell surface protein (Accession No. NP_471613.1).

A Gapped BlastP amino acid sequence alignment showed that SEQ ID NO:286 (414 amino acids) has about 65% identity from amino acids 21-404 with a hypothetical protein from *Lactobacillus johnsonii* (Accession No. NP_964852.1), about 64% identity from amino acids 21-404 with a protein from *Lactobacillus gasseri* that is a bacterial cell division membrane protein (Accession No. ZP_00046289.1), about 39% identity from amino acids 23-407 with a protein from *Lactobacillus plantarum* that is a cell division protein FtsW (Accession No. NP_785648.1), about 36% identity from amino acids 48-411 with a protein from *Enterococcus faecalis* that is a cell division protein in the FtsW/RodA/SpoVE family (Accession No. NP_816105.1), and 35% identity from amino acids 48-404 with a protein from *Enterococcus faecium* that is a bacterial cell division membrane protein (Accession No. ZP_00035664.1).

A Gapped BlastP amino acid sequence alignment showed that SEQ ID NO:288 (151 amino acids) has about 53% identity from amino acids 1-149 with a protein from *Lactobacillus plantarum* that is an integral membrane protein (Accession No. NP_785439.1), about 58% identity from amino acids 18-146 with a protein from *Listeria monocytogenes* (Accession No. NP_465093.1), about 58% identity from amino acids 18-146 with a protein from *Listeria innocua* (Accession No. NP_470939.1), about 48% identity from amino acids 1-149 with a protein from *Enterococcus faecium* that is homologous to a membrane protein (Accession No. ZP_00036546.1), and 49% identity from amino acids 1-147 with a protein from *Enterococcus faecalis* (Accession No. NP_814972.1).

A Gapped BlastP amino acid sequence alignment showed that SEQ ID NO:290 (451 amino acids) has about 62% identity from amino acids 13-450 with a hypothetical protein from *Lactobacillus johnsonii* (Accession No. NP_965202.1), about 61% identity from amino acids 13-450 with a protein from *Lactobacillus gasseri* (Accession No. ZP_00046546.1), about 53% identity from amino acids 6-451 with a protein from *Lactobacillus plantarum* that is an integral membrane protein (Accession No. NP_783922.1), about 51% identity from amino acids 13-451 with a protein from *Leuconostoc mesenteroides* subsp. *mesenteroides* (Accession No. ZP_00062829.1), and 51% identity from amino acids 19-451 with a protein from Oenococcus oeni (Accession No. ZP_00070095.1).

A Gapped BlastP amino acid sequence alignment showed that SEQ ID NO:292 (374 amino acids) has about 75% identity from amino acids 1-374 with a protein from *Lactobacillus gasseri* that is homologous to a DNA methylase (Accession No. ZP_00045949.1), about 74% identity from amino acids 1-374 with a hypothetical protein from *Lactobacillus johnsonii* (Accession No. NP_965048.1), about 53% identity from amino acids 1-373 with a protein from *Lactobacillus plantarum* (Accession No. NP_785327.1), about 52% identity from amino acids 2-373 with a protein from *Leuconostoc mesenteroides* subsp. *mesenteroides* that is homologous to a DNA methylase (Accession No. ZP_00062777.1), and 50% identity from amino acids 2-373 with a conserved hypothetical protein from *Enterococcus faecalis* (Accession No. NP_814882.1).

A Gapped BlastP amino acid sequence alignment showed that SEQ ID NO:294 (242 amino acids) has about 79% identity from amino acids 1-238 with a protein from *Lactobacillus johnsonii* that is a tRNA (guanine-N1)-methyltransferase (Accession No. NP_965315.1), about 52% identity from amino acids 1-241 with a protein from *Lactobacillus plantarum* that is a tRNA (guanine-N1)-methyltransferase (Accession No. NP_785229.1), about 46% identity from amino acids 1-238 with a protein from *Leuconostoc mesenteroides* subsp. *mesenteroides* that is a tRNA methyltransferase (Accession No. ZP_00064008.1), 51% identity from amino acids 1-238 with a protein from *Bacillus cereus* that is a tRNA (guanine-N1)-methyltransferase (Accession No. NP_833560.1), and 51% identity from amino acids 1-236 with a protein from *Bacillus anthracis* that is a tRNA (guanine-N1)-methyltransferase (Accession No. NP_657810.1).

A Gapped BlastP amino acid sequence alignment showed that SEQ ID NO:296 (667 amino acids) has about 83% identity from amino acids 24-666 with a protein from *Lactobacillus johnsonii* that is a threonyl-tRNA synthetase (Accession No. NP_965452.1), about 83% identity from amino acids 24-666 with a protein from *Lactobacillus gasseri* that is a threonyl-tRNA synthetase (Accession No. ZP_00046734.1), about 61% identity from amino acids 25-665 with a protein from *Lactobacillus plantarum* that is a threonine-tRNA ligase 1 (Accession No. NP_785120.1), about 57% identity from amino acids 28-665 with a protein from *Streptococcus mutans* that is homologous to a threonyl-tRNA synthetase (Accession No. NP_721923.1), and 56% identity from amino acids 28-665 with a protein from

*Lactococcus lactis* subsp. *lactis* that is a threonyl-tRNA synthetase (Accession No. NP_268068.1).

A Gapped BlastP amino acid sequence alignment showed that SEQ ID NO:298 (706 amino acids) has about 24% identity from amino acids 123-511 with a protein from *Lactobacillus plantarum* that is a cell surface protein precursor (Accession No. NP_786268.1), about 29% identity from amino acids 220-510 with a protein from *Enterococcus faecium* that is an autotransporter adhesin (Accession No. ZP_00035995.1), about 23% identity from amino acids 181-503 with a protein from *Fusobacterium nucleatum* subsp. *nucleatum* that is a hemolysin (Accession No. NP_603198.1), about 19% identity from amino acids 26-260 with a protein from *Staphylococcus aureus* subsp. *aureus* that is a fibrinogen-binding protein (Accession No. NP_645581.1), and 25% identity from amino acids 383-509 with a hypothetical protein from *Microbulbifer degradans* (Accession No. ZP_00064879.1).

A Gapped BlastP amino acid sequence alignment showed that SEQ ID NO:300 (438 amino acids) has about 31% identity from amino acids 116-297 with a hypothetical protein from *Streptococcus mutans* (Accession No. NP_722210.1), about 50% identity from amino acids 116-188 with a protein from *Lactobacillus salivarius* subsp. *salivarius* (Accession No. gb|AAM61773.1), about 29% identity from amino acids 126-220 with a protein from *Streptococcus agalactiae* that is homologous to a bacteriocin transport accessory protein (Accession No. NP_687482.1), 24% identity from amino acids 125-338 with a protein from *Bradyrhizobium japonicum* that is a thioredoxin (Accession No. NP_767234.1), and 27% identity from amino acids 123-201 with a protein from *Bacillus anthracis* (Accession No. NP_052783.1).

A Gapped BlastP amino acid sequence alignment showed that SEQ ID NO:302' (372 amino acids) has about 55% identity from amino acids 11-371 with a protein from *Leuconostoc mesenteroides* subsp. *mesenteroides* that is a methionine synthase II (cobalamin-independent) protein (Accession No. ZP_00064070.1), about 47% identity from amino acids 5-372 with a protein from *Lactobacillus gasseri* that is a methionine synthase II (cobalamin-independent) protein (Accession No. ZP_00046311.1), about 46% identity from amino acids 7-372 with a hypothetical protein from *Chlamydophila pneumoniae* (Accession No. NP_224351.1), 44% identity from amino acids 4-372 with a hypothetical protein from *Lactobacillus johnsonii* (Accession No. NP_965623.1), and 45% identity from amino acids 9-372 with a protein from *Oenococcus oeni* that is a methionine synthase II (cobalamin-independent) protein (Accession No. ZP_00069898.1).

A Gapped BlastP amino acid sequence alignment showed that SEQ ID NO:304 (157 amino acids) has about 87% identity from amino acids 1-157 with a protein from *Lactobacillus johnsonii* that is an autoinducer-2 production protein LuxS (Accession No. NP_965624.1), about 87% identity from amino acids 1-157 with a protein from *Lactobacillus gasseri* that is a LuxS protein involved in autoinducer A12 synthesis (Accession No. ZP_00046310.1), about 76% identity from amino acids 4-157 with a protein from *Streptococcus bovis* that is a LuxS autoinducer 2 synthase (Accession No. dbj|BAD06876.1), 77% identity from amino acids 1-157 with a protein from *Lactobacillus plantarum* that is an autoinducer production protein (Accession No. NP_784522.1), and 73% identity from amino acids 4-157 with a protein from *Streptococcus pyogenes* that is an autoinducer-2 production protein (Accession No. NP_269689.1).

A Gapped BlastP amino acid sequence alignment showed that SEQ ID NO:306 (599 amino acids) has about 37% identity from amino acids 225-343 with a protein from *Lactobacillus crispatus* that is an S-layer protein (Accession No. emb|CAA07708.1), about 34% identity from amino acids 225-343 with a protein from *Lactobacillus crispatus* that is a surface layer protein (Accession No. gb|AAB58734.1), about 33% identity from amino acids 225-343 with a protein from *Lactobacillus crispatus* that is a silent surface layer protein (Accession No. dbj|BAC76687.1), about 34% identity from amino acids 225-343 with a protein from *Lactobacillus crispatus* that is homologous to a silent surface layer protein (Accession No. gb|AAF68972.1), and about 30% identity from amino acids 137-284 with a protein from *Lactobacillus helveticus* that is an extracellular proteinase (EC 3.4.21.-) (prtY) (Accession No. pir||JC7306).

EXAMPLE 2

PFAM Results for Amino Acid Sequences

SEQ ID NO:2 contains a predicted Lipoprotein_4 domain located from about amino acids 25 to 306, and is a member of the Periplasmic solute binding protein family (SBP_bac_9)(PFAM Accession PF01297).

SEQ ID NO:10 contains a predicted Glyco_hydro_32 domain located from about amino acids 24 to 409, and is a member of the Glycosyl hydrolases family 32 (Glyco_hydro_32)(PFAM Accession PF00251).

SEQ ID NO:62 contains a predicted SLAP domain located from about amino acids 1 to 456, and is a member of the Bacterial surface layer protein family (SLAP) (PFAM Accession PF03217).

SEQ ID NO:82 contains a predicted Amidase_2 domain located from about amino acids 59 to 208, and is a member of the N-acetylmuramoyl-L-alanine amidase (Amidase_2) family (PFAM Accession PF01510).

SEQ ID NO:92 contains a predicted FTSW_RODA_SPOVE domain located from about amino acids 15 to 388, and is a member of the Cell cycle protein family (FTSW_RODA_SPOVE) (PFAM Accession PF01098).

SEQ ID NO:94 contains a predicted Mur_ligase domain located from about amino acids 43 to 293, and a predicted Mur_ligase_C domain from about amino acids 301-390, and is a member of the Mur ligase, catalytic domain family (Mur_ligase) (PFAM Accession PF01225) and the Mur ligase, glutamate ligase domain family (Mur_ligase_C) (PFAM Accession PF02875).

SEQ ID NO:98 contains a predicted Mur_ligase C domain located from about amino acids 365 to 454, and is a member of the Mur_ligase, glutamate ligase domain family (Mur_ligase_C) (PFAM Accession PF02875).

SEQ ID NO:100 contains a predicted Mur_ligase domain located from about amino acids 48 to 309, and a predicted Mur_ligase_C domain from about amino acids 317-394, and is a member of the Mur ligase, catalytic domain family (Mur_ligase) (PFAM Accession PF01225) and the Mur ligase, glutamate ligase domain family (Mur_ligase_C) (PFAM Accession PF02875).

SEQ ID NO:102 contains a predicted Glyco_transf_28 domain located from about amino acids 2 to 287, and is a member of the Glycosyltransferase family 28 N-terminal domain (Glyco_transf_28) (PFAM Accession PF03033).

SEQ ID NO:104 contains a predicted Glycos_transf_4 domain located from about amino acids 82 to 254, and is a member of the Glycosyl transferase family (Glycos_transf_4) (PFAM Accession PF00953).

SEQ ID NO:106 contains a predicted Amidase_4 domain located from about amino acids 63 to 212, and is a member of the Mannosyl-glycoprotein endo-beta-N-acetylglucosamidase family (Amidase_4) (PFAM Accession PF01832).

SEQ ID NO:108 contains a predicted Amidase_4 domain located from about amino acids 43 to 196, and is a member of the Mannosyl-glycoprotein endo-beta-N-acetylglucosamidase family (Amidase_4) (PFAM Accession PF01832).

SEQ ID NO:110 contains a predicted LysM domain located from about amino acids 110 to 153, and is a member of the LysM domain family (LysM) (PFAM Accession PF01476).

SEQ ID NO:112 contains a predicted Dala_Dala_ligas (Dala_Dala_lig_N) domain located from about amino acids 5 to 343, and is a member of the D-ala D-ala ligase N terminus family (Dala_Dala_lig_N) (PFAM Accession PF01820).

SEQ ID NO: 116 contains a predicted Mur ligase domain located from about amino acids 36 to 303, and is a member of the Mur ligase, catalytic domain family (Mur_ligase) (PFAM Accession PF01225).

SEQ ID NO: 118 contains a predicted Peptidase_S 11 domain located from about amino acids 25 to 321, and is a member of the D-alanyl-D-alanine carboxypeptidase family (Peptidase_S11) (PFAM Accession PF00768).

SEQ ID NO:120 contains a predicted EPSP_synthase domain located from about amino acids 16 to 419, and is a member of the EPSP synthase (3-phoshoshikimate 1-carboxyvinyltransferase) family (EPSP_synthase) (PFAM Accession PF00275).

SEQ ID NO:122 contains a predicted NTP_transferase domain located from about amino acids 4 to 233, and is a member of the Bacterial transferase hexapeptide (three repeats) family (Hexapep) (PFAM Accession PF00132).

SEQ ID NO:124 contains a predicted Prenyltransf (UPP_synthetase) domain located from about amino acids 14 to 238, and is a member of the Putative undecaprenyl diphosphate synthase family (Prenyltransf) (PFAM Accession PF01255).

SEQ ID NO:126 contains a predicted Glycos_transf_4 domain located from about amino acids 74 to 240, and is a member of the Glycosyl transferase family (Glycos_transf_4) (PFAM Accession PF00953).

SEQ ID NO:132 contains a predicted Transpeptidase domain located from about amino acids 331 to 693, and is a member of the Penicillin binding protein transpeptidase domain family (Transpeptidase) (PFAM Accession PF00905).

SEQ ID NO:134 contains a predicted Transglycosyl domain located from about amino acids 82 to 251, and a predicted Transpeptidase domain located from about amino acids 336 to 640, and is a member of the Transglycosylase family (Transgly)(Transglycosyl) (PFAM Accession PF00912), as well as the Penicillin binding protein transpeptidase domain family (Transpeptidase) (PFAM Accession PF00905).

SEQ ID NO:138 contains a predicted Transglycosyl domain located from about amino acids 70 to 242, and a predicted Transpeptidase domain located from about amino acids 324 to 629, and is a member of the Transglycosylase family (Transgly)(Transglycosyl) (PFAM Accession PF00912), as well as the Penicillin binding protein transpeptidase domain family (Transpeptidase) (PFAM Accession PF00905).

SEQ ID NO:146 contains a predicted Transpeptidase domain located from about amino acids 259 to 593, and is a member of the Penicillin binding protein transpeptidase domain family (Transpeptidase) (PFAM Accession PF00905).

SEQ ID NO:148 contains a predicted AMP-binding domain located from about amino acids 30 to 426, and is a member of the AMP-binding enzyme family (AMP-binding) (PFAM Accession PF00501).

SEQ ID NO:156 contains a predicted Polysacc_synt domain located from about amino acids 3 to 269, and is a member of the Polysaccharide biosynthesis protein family (Polysacc_synt) (PFAM Accession PF01943).

SEQ ID NO:158 contains a predicted GLF domain located from about amino acids 1 to 154, and is a member of the UDP-galactopyranose mutase family (GLF) (PFAM Accession PF03275).

SEQ ID NO:164 contains a predicted Glycos_transf_2 domain located from about amino acids 7 to 179, and is a member of the Glycosyl transferase family (Glycos_transf_2) (PFAM Accession PF00535).

SEQ ID NO:170 contains a predicted Glycos_transf_2 domain located from about amino acids 5 to 171, and is a member of the Glycosyl transferase family (Glycos_transf_2) (PFAM Accession PF00535).

SEQ ID NO:174 contains a predicted Bac_transf (Bact_transf) domain located from about amino acids 24 to 217, and is a member of the Bacterial sugar transferase family (Bac_transf) (Bact_transf) (PFAM Accession PF02397).

SEQ ID NO:180 contains a predicted Wzz domain located from about amino acids 9 to 186, and is a member of the Chain length determinant protein family (Wzz) (PFAM Accession PF02706).

SEQ ID NO:190 contains a predicted NLPC_P60 domain located from about amino acids 141 to 249, and is a member of the NlpC/P60 family (NLPC_P60) (PFAM Accession PF00877).

SEQ ID NO:194 contains a predicted NLPC_P60 domain located from about amino acids 152 to 260, and is a member of the NlpC/P60 family (NLPC_P60) (PFAM Accession PF00877).

SEQ ID NO:196 contains a predicted NLPC_P60 domain located from about amino acids 77 to 182, and is a member of the NlpC/P60 family (NLPC_P60) (PFAM Accession PF00877).

SEQ ID NO:208 contains a predicted Ribonuc_red_sm domain located from about amino acids 1 to 283, and is a member of the Ribonucleotide reductase, small chain family (Ribonuc_red_sm) (PFAM Accession PF00268).

SEQ ID NO:214 contains a predicted DUF59 domain located from about amino acids 9 to 83, and is a member of the Domain of unknown function DUF59 family (DUF59) (PFAM Accession PF01883).

SEQ ID NO:216 contains a predicted UPF0051 domain located from about amino acids 2 to 73, and is a member of the Uncharacterized protein family (UPF0051) (PFAM Accession PF01458).

SEQ ID NO:218 contains a predicted ABC_tran domain located from about amino acids 35 to 73, and is a member of the ABC transporter family (ABC_tran) (PFAM Accession PF00005).

SEQ ID NO:226 contains predicted ABC_tran domains located from about amino acids 29 to 232, and from about amino acids 347 to 512, and is a member of the ABC transporter family (ABC_tran) (PFAM Accession PF00005).

SEQ ID NO:236 contains a predicted Glycos_transf_2 domain located from about amino acids 8 to 171, and is a member of the Glycosyl transferase family (Glycos_transf_2) (PFAM Accession PF00535).

SEQ ID NO:238 contains a predicted Polysacc_synt domain located from about amino acids 4 to 273, and is a member of the Polysaccharide biosynthesis protein family (Polysacc_synt) (PFAM Accession PF01943).

SEQ ID NO:242 contains a predicted Glycos_transf_1 domain located from about amino acids 57 to 233, and is a member of the Glycosyl transferases group 1 family (Glycos_transf_1) (PFAM Accession PF00534).

SEQ ID NO:244 contains a predicted Epimerase_2 domain located from about amino acids 45 to 365, and is a member of the UDP-N-acetylglucosamine 2-epimerase family (Epimerase_2) (PFAM Accession PF02350).

SEQ ID NO:246 contains a predicted Epimerase_2 domain located from about amino acids 64 to 384, and is a member of the UDP-N-acetylglucosamine 2-epimerase family (Epimerase_2) (PFAM Accession PF02350).

SEQ ID NO:250 contains a predicted Glycos_transf_1 domain located from about amino acids 189 to 359, and is a member of the Glycosyl transferases group 1 family (Glycos_transf 1) (PFAM Accession PF00534).

SEQ ID NO:252 contains a predicted Glycos_transf_2 domain located from about amino acids 51 to 152, and is a member of the Glycosyl transferase family (Glycos_transf_2) (PFAM Accession PF00535).

SEQ ID NO:258 contains a predicted Glycos_transf_1 domain located from about amino acids 174 to 341, and is a member of the Glycosyl transferases group 1 family (Glycos_transf_1) (PFAM Accession PF00534).

SEQ ID NO:260 contains a predicted Alpha-amylase domain located from about amino acids 18 to 412, and is a member of the Alpha amylase, catalytic domain family (Alpha-amylase) (PFAM Accession PF00128).

SEQ ID NO:262 contains a predicted Glyco_hydro_31 domain located from about amino acids 110 to 757, and is a member of the Glycosyl hydrolases family 31 (Glyco_hydro_31) (PFAM Accession PF01055).

SEQ ID NO:264 contains a predicted Glyco_hydro_31 domain located from about amino acids 83 to 757, and is a member of the Glycosyl hydrolases family 31 (Glyco_hydro_31) (PFAM Accession PF01055).

SEQ ID NO:266 contains a predicted Alpha-amylase domain located from about amino acids 18 to 410, and is a member of the Alpha amylase, catalytic domain family (Alpha-amylase) (PFAM Accession PF00128).

SEQ ID NO:268 contains a predicted Glyco_hydro_31 domain located from about amino acids 68 to 682, and is a member of the Glycosyl hydrolases family 31 (Glyco_hydro_31) (PFAM Accession PF01055).

SEQ ID NO:270 contains a predicted Alpha-amylase domain located from about amino acids 28 to 429, and is a member of the Alpha amylase, catalytic domain family (Alpha-amylase) (PFAM Accession PF00128).

SEQ ID NO:272 contains a predicted Isoamylase_N domain located from about amino acids 23 to 109, and an Alpha-amylase domain located from about amino acids 145 to 495, and is a member of the Isoamylase N-terminal domain family (Isoamylase_N) (PFAM Accession PF02922) and the Alpha amylase, catalytic domain family (Alpha-amylase) (PFAM Accession PF00128).

SEQ ID NO:274 contains a predicted Alpha-amylase_N domain located from about amino acids 1 to 121, and an Alpha-amylase domain located from about amino acids 140 to 503, and is a member of the Alpha amylase, catalytic domain family (Alpha-amylase) (PFAM Accession PF00128) and the Alpha amylase, N-terminal ig-like domain family (Alpha-amylase_N) (PFAM Accession PF02903).

SEQ ID NO:276 contains a predicted Alpha-amylase domain located from about amino acids 548 to 926, and is a member of the Alpha amylase, catalytic domain family (Alpha-amylase) (PFAM Accession PF00128).

SEQ ID NO:278 contains a predicted Alpha-amylase domain located from about amino acids 133 to 505, and is a member of the Alpha amylase, catalytic domain family (Alpha-amylase) (PFAM Accession PF00128).

SEQ ID NO:286 contains a predicted FTSW_RODA_SPOVE domain located from about amino acids 29 to 405, and is a member of the Cell cycle protein family (FTSW_RODA_SPOVE) (PFAM Accession PF01098).

SEQ ID NO:292 contains a predicted UPF0020 domain located from about amino acids 163 to 368, and is a member of the Putative RNA methylase family UPF0020 (UPF0020) (PFAM Accession PF01170).

SEQ ID NO:294 contains a predicted tRNA_m1G_MT domain located from about amino acids 21 to 226, and is a member of the tRNA (Guanine-1)-methyltransferase (tRNA_m1G_MT) (PFAM Accession PF01746).

SEQ ID NO:296 contains a predicted TGS domain located from about amino acids 22 to 85, a predicted tRNA-synt_2b domain located from about amino acids 283 to 438, and a predicted HGTP_anticodon domain located from about amino acids 562 to 659, and is a member of the tRNA synthetase class II core domain family (G, H, P, S and T)(tRNA-synt_2b) (PFAM Accession PF00587), the Anti-codon binding domain family (HGTP_anticodon) (PFAM Accession PF03129), and the TGS domain family (TGS) (PFAM Accession PF02824).

SEQ ID NO:304 contains a predicted LuxS domain located from about amino acids 2 to 155, and is a member of the LuxS protein family (LuxS) (PFAM Accession PF02664).

EXAMPLE 3

Identification of Sequences Involved in Cell Adhesion

The ability of microorganisms to adhere to mucosal surfaces can provide a distinct advantage when establishing residence in the gastrointestinal tract. *Lactobacilli* are normal components of the intestinal microbiota, although the molecular mechanisms by which these organisms attach to the epithelium have not yet been fully characterized. In order to identify genes potentially involved with adhesion in *L. acidophilus* NCFM, the complete genomic sequence was analyzed and open reading frames (ORFs) similar to genes previously shown to be involved with adhesion were selected, including two streptococcal R28 homologs (SEQ ID NO:76 and SEQ ID NO:78, designated as ORF 1633 and ORF 1634, respectively in FIG. 1), a fibronectin binding protein (FpbA)(SEQ ID NO:58), and a mucin binding protein (Mub) (SEQ ID NO:18). To determine their impact on adhesion, these genes were targeted for insertional inactivation using the integration tools and strategy described by (Russell and Klaenhammer (2001) *Appl. Environ. Microbiol.* 67:4361-4364). Due to the interactive nature of bacterial surface components with adhesion, a strain containing an inactivated surface layer protein (SlpA) (SEQ ID NO:60) was also evaluated for adhesive properties. All mutants were assessed for their adhesive properties on Caco-2 cells in comparison to *L. acidophilus* NCFM LacL⁻ which was used as an antibiotic control and designated as wild type. Caco-2 cells express many of the markers associated with normal small intestine villus cells and are commonly used to study bacterial adherence.

The two R28 homolog mutants, SEQ ID NO:76 and SEQ ID NO:78, did not show reproducible decreases in adhesion (see FIG. 1). SlpA (SEQ ID NO:60), the surface layer mutant, showed the highest decrease in adhesion while the fibronectin (SEQ ID NO:58) and mucin binding (SEQ ID NO:18) mutants both had significant decreases in adhesion when compared to the wild type. These data suggest that fibronectin binding protein, surface layer protein, and mucin binding protein contribute to attachment or adherence processes.

Adhesion Assays

Caco-2 cells were grown on cell-culture treated coverslips for 15 days to achieve proper differentiation and expression of intestinal markers. The monolayers were then treated with a bacterial suspension at a concentration of about $4 \times 10^8$ bacteria/ml. Middle log-phase bacterial populations were used grown in MRS with 2.5 µg/ml Em to maintain selection. Bacteria were incubated on the monolayers for 1.5 hr at 37° C. in a mixture of MRS and cell line culture medium (Minimum Essential Medium supplemented with 20% Fetal Bovine Serum). Following incubation, the monolayers were washed five times with phosphate-buffered saline (PBS), fixed in methanol, and Gram-stained. The coverslips were then transferred to a microscope slide where the cells were enumerated. For statistical purposes, 17 fields were enumerated in a fixed grid for each coverslip; duplicate coverslips were counted for each experiment. Total counts for each coverslip were used and adhesion was expressed as percent (%) of the control. *L. acidophilus*, NCFM::lacL, harboring pOR128 integrated into the β-galactosidase gene. Integration into lacL was not found to influence adhesion and the control could be propagated under the same antibiotic selection conditions as all the other integrants.

All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (308 sequences)

SEQ ID NO: 1 - DNA, 918 bp, Lactobacillus acidophilus
  misc_feature (0)...(0): ORF 1773 - psaA adhesin
  CDS (1)...(918)
atgctttttttatggaggaaaattatgcaaaattggaaaactagaattacaaaattatcttttctcataggtattgtgggaacaatcatgctttttgtttctgcttgttcaaataataaacaatcttcaactaatgatggtaagatttcgatcgttacctcaactaatgtttatgcagatattgctaagaatatagttggtaagtacggcagtgctaaggcaattattaaaaatagtgctactgatccgcatgactttgaaccaactactcaagacgctaaggaattatctagtaccaatattattgtagctaacggtttaggctatgatagctggatgaacaagttagctagctcagttgataagaagccagttttagttggtgaagagctaatgaagttaaagaaaggggctaaccctcatatttggtacagtttaagtatgccaactgagtatgttgattatttagtgaaacgtttatcaaaaatcgattccaagcacaaagcatactttgaagctaatggtaaaaaatatttagctaagattaatcaggtaaaggctcttgctaaaaatagtaaaaagaccgataagatggtttttgttagtgaacccgtctttgattacgccttagctgaagctggttacaagattggtgacaaggactttgaaaaagctgtagaaaacaacacagatccaagtcctaaaactattaacagaatgacaaatgatattaagaataagaagatcgcattctttgttaacaatactcaatcaagtagttcaactgtaaagacatttgttaaattggcaaaacaaaataatattccagtattgaacgtgcgcgaaactattcctaatcacacaacttacttaaattggatgaaggaaaattatcaaaatttagctaatattagtaag

SEQ ID NO: 2 - protein, 306 aa, Lactobacillus acidophilus
MLFLWRKIMQNWKTRITKLSFLIGIVGTIMLFVSACSNNKQSSTNDGKISIVTSTNVYADIAKNIVGKYGSAKAIIKNSATDPHDFEPTTQDAKELSSTNIIVANGLGYDSWMNKLASSVDKKPVLVGEELMKLKKGANPHIWYSLSMPTEYVDYLVKRLSKIDSKHKAYFEANGKKYLAKINQVKALAKNSKKTDKMVFVSEPVFDYALAEAGYKIGDKDFEKAVENNTDPSPKTINRMTNDIKNKKIAFFVNNTQSSSSTVKTFVKLAKQNNIPVLNVRETIPNHTTYLNWMKENYQNLANISK

SEQ ID NO: 3 - DNA, 573 bp, Lactobacillus acidophilus
  misc_feature (0)...(0): ORF 97 - lemA protein
  CDS (1)...(573)
atggaggattctatcatgtcaccattactttggataattttaattatcattgttttaatagtagctatctatatcactacttataacggtttacaaagatctcgtgtatatgtagacgaagcatggagccaaattgacgttcaattaaaacgacgtaatgacttaattcctaacttagttgaaactaccaaaggttatgcacaacacgaaaaatctacttttgagagtatagttaaacttagagatgaattaactcaagttccacaaggtaaccatgaagaagcaatgaagctatctaatcagcttaccgattccttgaagtccatctttgctttagcagaggcataccctgaccttaaagcaaatcaaaacttcttaaaacttcaagaggaattgactaatactgaaaataaaattgcttattctcgtcagctttataactcatcagttgctacatacgatcaaaaattattaactttcccctcaaacttaattgctaaaattcacggctttactaaggttaactacttggaaactcctgcagaagaaaagaatgtacctaaagttaaattt

SEQ ID NO: 4 - protein, 191 aa, Lactobacillus acidophilus
MEDSIMSPLLWIILIIIVLIVAIYITTYNGLQRSRVYVDEAWSQIDVQLKRRNDLIPNLVETTKGYAQHEKSTFESIVKLRDELTQVPQGNHEEAMKLSNQLTDSLKSIFALAEAYPDLKANQNFLKLQEELTNTENKIAYSRQLYNSSVATYDQKLLTFPSNLIAKIHGFTKVNYLETPAEEKNVPKVKF

SEQ ID NO: 5 - DNA, 7617 bp, Lactobacillus acidophilus
  misc_feature (0)...(0): ORF - 1611 FmtB surface protein
  CDS (1)...(7617)
ttgactaccattaataatgcaaaagatgctttaaatggggatgttaagaaagcagcaagtaaggaagctcttcaaaaagcagttgatgaagcacctactgtaaaatcagatgatgcggcatactacaatggttctgatgaagctaaggctgcttatgataaggcaatcagtgccggtcaaacagttttaaataatccagatgcaaccgctactcaaattactgatgctttaaatgccattaatactgctaagggtgactttgatggtaaaactaccgataaatcagcacttgaaactgcaattaataattctaaaactgtaaaagacagcaacaactatactaatgcagacgaaactcaaaagactgcatatgatagtgcagtaacatctgcacaaatagttttagataaaactaatgcaactcaagcagaagtgaaccaagctcttcaagatcttgaaactgcaaataataacctaaatggggatgctaagactgaagctgcaaacaaggctgccttagaagctgccgttaaggatgcgccaaatgtaagaaatacgcctgcatactacaacggtactaacgaagctcaaacaacatataataatgcaattaatgctgggcaagcagttttagatcaggcaaatccatctgcaaatgacgttaagtctgctttagatgcaattaatgcagcaaaagctaaccttaaaggtgaagctactaatactacatctttggaaacagctttaaccaatgctaataatgttaagaacactggtaactacactaatgctgatcaagcaaaacaagaagctcttaataatacaattattgctggtcaagatcttttaaagaatactaatgcaactcaggcagaagtagacaatgcagcaaaggctattactaatgcaattaatggcttgaatggggatactaaccttacaaatgctaagaatgctgctactgaagatattcaaaaggcattagatagtaagactaccgaaatcactgacgctactaatattgatcaagctactaaggatcaattaattgcggatgctaaaaaggcagcagaagatgctaatactgctattaatcaagcaaccaatgccgatgcagttaatactgctaaaactgaaggaattgctaatatcaataaggtgacagttccaagtttagatgatgctaaaactaaggcagccaaagaaattgatcaagcattaactgataagaccaaggaaatcactgatgctgaaaatattgatcaaacaactaaagatcagttaattaaagaagcaactgatgcagcaaatacagcaaaagatactattgaaaaatctacaactaacgacgaagcaactaaagcaggccaagatggtgtagatgcagttaacaatgtaaaggtaccaagcgttactgatagtcaaaatgcggcaaaagatgctattgatgatgcccttaacgctaagactaaggaaatcaacgatgctaacaatattgatcaaacaactaaggatcaattaatcaaagaagcaaccgatgcagctaataatgctaaagaagccattgataaagcaaccacagctgatgcaattaagactgcacaagatgaaggaaccactaacatcaacaatgttactgttccaagcttagaggatgccaagaaggcagcaactaaagcagtagatgatgctcttactgctcaaactgaagtaattaataaagctgataatcttagtgatgcagaaaagaaagatctgattgatcaagcaactactgaagccaataaggctaaagaaagtattgaaactgctacgacaaacaatgaagcagctcaagcaggcaaagatggtgtggatgcaattaataagattgttccaacaagcttagatactgtgaaatctgatgcaaataaagcaattgatgatgctttaactaagaaattagaagagattaattcagctaatgctttaactactgatgaaaagaccgcgttaacacaagaagccaatacagctgcagctaaggcaaaagaaaaaattactaatgcaacaactaatgatgcagtaattgaagcacaaaataatggtgttactgcaattgatggaattaaagttccgactgaatcagcagtcaaagaagcagctaagaaggcagtagccgaagcagcaacagcaaagactaatgcaattgattcttcaaacttaacagctgaagaaaaagcggcattgaagcaagaagttactgaagctcaaacagctgctaatactgcaattgataatgcaactacaaacgcagacgtaactgaagctaaagacaaaggtattaaggcaattaatggtattgaagtaccaaataaatcagatactaagggaaaggcaatcactgatcttaacaacgaagttgaaaatgctaagaaagcaattgatcaagatagcaacttaactgatgaagagaagcaagcagctaaagaccaaattgactctgatgctaagactgctcaagatgctattaacaatgcaaagactaatgatgatgttaagaatgcagttgctgctggtacattagcaattgataaggatgttgctaatgcagccattgataatgcagctgctggtaagcttaaagaaatcaaagatccgttaactagtgaagagaaacaaacttacacagatttaattaattctgaggtaaataacgcaaaacaaaatattgctaatgcaacgactgttgaagaagtaactactgcacaaacaaacggtgtaaatgaaattactaataccaaaattccaaccacttcttcagccaaagataaggcaattgctgctatcaatgatgctcttcaaaagaagtctgacgaaatcaacaatgcctctaacatcaacactcaagaaaagactgatttaattaagcaagcaactgaagcagccaatactgctaaggataatatcaacaatgccactactaacgcggatgttaagactgcgcaaactaatggtgaaaaagcaattgctgatgtaacagttccaaacttgtctgatgttaagaaggaaaacattgatctcattaacaaggcgttagatgccaagacagacgaaatcaacaatgcttctaacctttctcaagatgaaaagcaaagtttgatcaatgatgcaactaatatcgcaactgaagcaattaacaacgtcaaccaatctcaaacaaatgacgatgctaaagctgctgcaactattggtgttcaaaatatcgagaatgttactattccaactcttgatgatgctaagaagaacgctaaccaagctattgatgctgcattgaattctaaagtaaatgagattaataatgcttctaacttgaatgacactgaaaagcaaaaattagttgatcaggcaaatgatgcagcaactactgcaaagaataatgttgaaaatgccactaccaatgatgctgctcgcgatgcagctaatgctggaattaataacattaaaggtattacctttacttcactagaagatgctaaaaatgcagcaaacactgcaattgacaatgcttttcaagttaagacagatgaaattaataatgcatctaacttaagtactgaagaaaagcaagacttaatcaatcaagcaagtgaagcagctaaaaatgcaaaagacaatatcaacaatgccactaccaatgatgctgtgactgacgcacagaataagggtattgcagatattgctaatgtgactgttccaagcttagatcaagttaaacaagatgcaattaatgcaattaagcaagttcaagatgctaagaataagcaaatttctaatgcatctaacctaagtgctgaagagcaaaaagaattaactgatcaagtagataaaattgctaacgatgcaattgctaagattaatgatgcagcaactactaccaatgatgcagttactgcaacctgcgatgaagcaatcaagcaaattactgatctatttattccaactctagacggtgcgcagacagatgctcttaatgcaattgaaagtgctaagaatgctaagctgaatgacattaacaatgctgctcacttaactgatcaagaaaagcaggctttggttgatcaaacaaataaagctgccgatgatgcaactaaggaaattaagggcgctcaaactaatgatgcagtcaagagtgcagaaacagccggtttagataatattaataaagttactattccaaccttagttcagaagcaacaagaagctattggagaattgaatgtagcacgtgatgctaagaatagggcaattgatgatgctactgatttaactactgatgaaaagaacagcttgaaagataaagttcaagcagaatacagtaacgcagtatcaaatatcaccagtgcaacaactgatgaagcagtaacaaccgctaaagaaaacggcatcaatgcaattaaagacattgaaatcccaactaagtcagctacgaaggaccaggcaaccacagaccttaagactgccgttgacgaagctaagaaggcaattgatcaagataacaacttgaacaatgagcaaaagcaagcagctaaagatcaaattgattctgatgctaagaaagctcaagaagccatcgataatgcgaagactgatgatgaggtaaacagtgccgttgataatggtaagcttgctattgataaagatattgctaatgccgccatcgacaatgcagttgctggtaagaaggacgaaattgctaaatcaccattaactgatgaagaaaagactgcgttaaataatgaagtcgatcaaaaggctcaagatgctaaagaagcaatcaataatgccactaccccagaagctgtaaccactgcgcaagacaatggtgttaagaatatcaatgatactgaagtgccaactgagtcaacagctaaagaagcagctaagaaagctattgcagaagcagccgaagctaagaacaatgcaatcgattcttcaaacttaacggacgaagaaaaaactgcattgaagcaggaagttactgatgcccaaaacgctgccaatactgcaattgataacgcaactaccaatgccgcagtaaccgaagcagaagacaatggtattaaagctattaatggtattggaatcccaactaagtcaccagctaaggaccaagcaatcactgaccttaatgatgccgttgacgaggctaagaaggcaattgaccaagataacaacttgactgatgccgaaaagcaagcagcgaaggatcaaatcgattccgatgctaagaaggcccaagaagccatcgataatgcgaagactgacgatgaggttaagactgccgttgacaatggtcagcttgccattgataaagatgttgctaatgccgccatcgacaatgcagttgctggtaagaaggctgaaattgcaaaggcaccattaaccaccgatgaagctaaggacttgaatgacttagttgaccaagaagcaaaggccgctaagaaggcaattgattcagctactactattccagcggttgacgatgctaagaataccggagttgctgcaatcaacaatattgcagttccaacaacttcatcaaccaaggatcaagctaaccaaacaattgatgatgctttagctaacaagactaaagaaatcaatgatgcaaccaacttatctgataagcaaaagcaagacttgattgatcaagccaacgaggaagcagcaaaggctaaggaaaacattaagaatgccactagcaatgaagcagtcaacaaagctactacagatggtgtagatgctattgcaaatgtcactgtcccaagtcttgatgatgcgaagaaagatgctagtcaattaattgacgacgttcttaagcaaaaagaagatgagatcaataatgcttcccacttgactgatcaagagaagcaagacctcattgaccaagcacaaaacgccgctgacgaagccaaagacaagatcaaccaagcgacaactaatgacgatgtagctacggaaagagatgcgggcgcagaaaagattgccaatattgttgttccgagtcttgaagatgctaaggataaagccacgaaggcaatagataacgctttagcagataagacgaaggaaattaatgatcaaaccaacttatctgatcaagaaaagaatgatcttatcaaccaaattactgatattgctgataaggcaaaggataagatcaataatgctgctactgatgcagatattgctaagaatgaaaaagatggtattgatgcaattgttgatactaagattcctggcttagaagatcataaaaagaatgcaattaattctttagatgaagctaaatctactaagcttgcccaaattgatggagcaactcatctaactgcaaatgaaaagaccgacttaactcaacaagttgatgcagaatacaataaggcacttgatgagatcaataaagctacaaccaatgatgatgcagataaagctagtgctgatggtgtggaagctatccttaatattaaagttccgagccttaatgaaaagaaacaagatagtataaatgctcttaatgaagtgcgtgatgctaagaaggatgaaatcaataaggcaactaatttaaaccaaaatgaaaaggacgagctgaacaaacaagttgatcaaattgctgataaagctattaatgcgatcaatgaagcaaatgatgatcaaacagctaaaaatgcagaaaataaaggtattcaagatattcttgatgtcaaagttccaagtctagatgaagttaagaataatgcaaagcaagcaattgctgatgcgttagaaagtaagcagaatgaaatcaataaggcagttaacttggatcaatctactaagcaagacttagttaatcaagctaagactgctgcagaaaatgctaataagaatattgatttagctacaactaatgacgaagtaatagctgcaagtaaaaagggtgtacaaaatattgaaaatattattgtcccagccccaagtacaaattcagacacttcaaatattagtactgatcaaactgattccgatgctaataagagccaagcacaagatagtaataagacttctaataatgatattaacaagaatactgataatccaaagcatagtaaatctggtaaaagttcggtgtctcttgatgataaaaagaatcaagcaattaatgagcttactaaagtagctgaagctaagaaagcagctattaatagtaccaatatttctgctgatgctaaagcaagacttaacgctcaagtagatcgtgaattggcacgtggtaaaaatagtattagccaagctagaaattcagaagaattaacaagtagtaagaatacagcaattgcaacgattaattcaattagtgttgctccaaagggcacccaaggggtaaatagtagagaaaactatggcaatactgatttaaataataatagtattactgttggtgaacgcccaatttctcacattccaacttctgataaacaagaaaccttgcctcaaactggacatcatactaatgaaggcttgacaattcttggtacattggttgccggtgtagcaggcttaattacacttgcaggaaccaagaagagaaaagat

SEQ ID NO: 6 - protein, 2539 aa, Lactobacillus acidophilus
MTTINNAKDALNGDVKKAASKEALQKAVDEAPTVKSDDAAYYNGSDEAKAAYDKAISAGQTVLNNPDATATQITDALNAINTAKGDFDGKTTDKSALETAINNSKTVKDSNNYTNADETQKTAYDSAVTSAQIVLDKTNATQAEVNQALQDLETANNNLNGDAKTEAANKAALEAAVKDAPNVRNTPAYYNGTNEAQTTYNNAINAGQAVLDQANPSANDVKSALDAINAAKANLKGEATNTTSLETALTNANNVKNTGNYTNADQAKQEALNNTIIAGQDLLKNTNATQAEVDNAAKAITNAINGLNGDTNLTNAKNAATEDIQKALDSKTTEITDATNIDQATKDQLIADAKKAAEDANTAINQATNADAVNTAKTEGIANINKVTVPSLDDAKTKAAKEIDQALTDKTKEITDAENIDQTTKDQLIKEATDAANTAKDTIEKSTTNDEATKAGQDGVDAVNNVKVPSVTDSQNAAKDAIDDALNAKTKEINDANNIDQTTKDQLIKEATDAANNAKEAIDKATTADAIKTAQDEGTTNINNVTVPSLEDAKKAATKAVDDALTAQTEVINKADNLSDAEKKDLIDQATTEANKAKESIETATTNNEAAQAGKDGVDAINKIVPTSLDTVKSDANKAIDDALTKKLEEINSANALTTDEKTALTQEANTAAAKAKEKITNATTNDAVIEAQNNGVTAIDGIKVPTESAVKEAAKKAVAEAATAKTNAIDSSNLTAEEKAALKQEVTEAQTAANTAIDNATTNADVTEAKDKGIKAINGIEVPNKSDTKGKAITDLNNEVENAKKAIDQDSNLTDEEKQAAKDQIDSDAKTAQDAINNAKTNDDVKNAVAAGTLAIDKDVANAAIDNAAAGKLKEIKDPLTSEEKQTYTDLINSEVNNAKQNIANATTVEEVTTAQTNGVNEITNTKIPTTSSAKDKAIAAINDALQKKSDEINNASNINTQEKTDLIKQATEAANTAKDNINNATTNADVKTAQTNGEKAIADVTVPNLSDVKKENIDLINKALDAKTDEINNASNLSQDEKQSLINDATNIATEAINNVNQSQTNDDAKAAATIGVQNIENVTIPTLDDAKKNANQAIDAALNSKVNEINNASNLNDTEKQKLVDQANDAATTAKNNVENATTNDAARDAANAGINNIKGITFTSLEDAKNAANTAIDNAFQVKTDEINNASNLSTEEKQDLINQASEAAKNAKDNINNATTNDAVTDAQNKGIADIANVTVPSLDQVKQDAINAIKQVQDAKNKQISNASNLSAEEQKELTDQVDKIANDAIAKINDAATTTNDAVTATCDEAIKQITDLFIPTLDGAQTDALNAIESAKNAKLNDINNAAHLTDQEKQALVDQTNKAADDATKEIKGAQTNDAVKSAETAGLDNINKVTIPTLVQKQQEAIGELNVARDAKNRAIDDATDLTTDEKNSLKDKVQAEYSNAVSNITSATTDEAVTTAKENGINAIKDIEIPTKSATKDQATTDLKTAVDEAKKAIDQDNNLNNEQKQAAKDQIDSDAKKAQEAIDNAKTDDEVNSAVDNGKLAIDKDIANAAIDNAVAGKKDEIAKSPLTDEEKTALNNEVDQKAQDAKEAINNATTPEAVTTAQDNGVKNINDTEVPTESTAKEAAKKAIAEAAEAKNNAIDSSNLTDEEKTALKQEVTDAQNAANTAIDNATTNAAVTEAEDNGIKAINGIGIPTKSPAKDQAITDLNDAVDEAKKAIDQDNNLTDAEKQAAKDQIDSDAKKAQEAIDNAKTDDEVKTAVDNGQLAIDKDVANAAIDNAVAGKKAEIAKAPLTTDEAKDLNDLVDQEAKAAKKAIDSATTIPAVDDAKNTGVAAINNIAVPTTSSTKDQANQTIDDALANKTKEINDATNLSDKQKQDLIDQANEEAAKAKENIKNATSNEAVNKATTDGVDAIANVTVPSLDDAKKDASQLIDDVLKQKEDEINNASHLTDQEKQDLIDQAQNAADEAKDKINQATTNDDVATERDAGAEKIANIVVPSLEDAKDKATKAIDNALADKTKEINDQTNLSDQEKNDLINQITDIADKAKDKINNAATDADIAKNEKDGIDAIVDTKIPGLEDHKKNAINSLDEAKSTKLAQIDGATHLTANEKTDLTQQVDAEYNKALDEINKATTNDDADKASADGVEAILNIKVPSLNEKKQDSINALNEVRDAKKDEINKATNLNQNEKDELNKQVDQIADKAINAINEANDDQTAKNAENKGIQDILDVKVPSLDEVKNNAKQAIADALESKQNEINKAVNLDQSTKQDLVNQAKTAAENANKNIDLATTNDEVIAASKKGVQNIENIIVPAPSTNSDTSNISTDQTDSDANKSQAQDSNKTSNNDINKNTDNPKHSKSGKSSVSLDDKKNQAINELTKVAEAKKAAINSTNISADAKARLNAQVDRELARGKNSISQARNSEELTSSKNTAIATINSISVAPKGTQGVNSRENYGNTDLNNNSITVGERPISHIPTSDKQETLPQTGHHTNEGLTILGTLVAGVAGLITLAGTKKRKD

SEQ ID NO: 7 - DNA, 1773 bp, Lactobacillus acidophilus
  misc_feature (0)...(0): ORF 649 - 67 kDa Myosin-crossreactive streptococcal antigen
  CDS (1)...(1773)
atgtattattccaatggtaattacgaagcatttgcagatcctaagaaacctgcaggcgtggacaagaaatctgcttatattattggtagtggtctagctggtctttctacagccgtatttttagtacgagatgcacaaatgaaaggtgaaaatattcatattttagaagaattaccagttgctggtggttctcttgatggtgcagatcgtcccaatgcgggctttgttgttcgtggtggacgcgaaatggagaatcattttgaatgtttatgggatatgtaccgctcaattccaagtttggaagttccaggcgcatcgtatcttgatgaatattattggcttgacaaagaagatcccaattcatcaaattgtcgtttaatttataatcgtggagatcgtcttccaagtgatggacaatatggtttaggcaaatgtgctaatgaaattgtcaagttgattatgacccctgaaaaggaaattgaagggcaaactattgaagaatttttcagtgatgagttctttaagactaatttctggacatactggtcaacaatgtttgcttttgaaaaatggcattcattagccgaaatgcgccgttatgcaatgcgctttattcatcatattgatgggttgcctgattttactgccttaaagtttaataagtataatcaatatgaatcaatggttaaaccacttcttgcatatcttaaagatcatggtgtgcaatttgaatatgactgccatgttaagaatgtcgaggtagatcatgaaggcgacagtaaaattgccaagaagattgttatgacgcagaatggcaaagataaagaaattgatttaacacataatgacatcgtctttgtaactaacggttcaattactgaaagttctacttatggtgatcagaatactccagctccaattactaatgctaaaggtgattcatggaagttatgggaaaatttggctaagcaagatccagctttcggtcatccagatgtattctgcgaaaacctaccagaacgtagttggtttgtttccgcaactgctacattggagaataagaagcttgcaccatattttgagcgcttaaccaagcgcagtttgtatgatggtaaggttaacacaggtggtattattactatcgttgattctaactgggaacttagttttactattcaccgtcaaccacattttaagagtcaaaacccagaccaaattgttgtttggatttatgcactttattcagatactgaaggtaactatattaaaaagagaattgttgattgtactggcaaagaaattgcagaagagttgctttaccacttaggtgttcccgaaagccaaattagtgaattggccagcgaggaaaatatgaataccgtaccagtttatatgccatatattactagttacttcatgcctcgtcgtgatggtgatcgtccagatgttgtgccagaaggatcaataaaccttgcctttattggtaattttgcagaatctccaacaagagatactgtgtttactactgagtattctgtcagaacagctatggaggctgtttatacattacttaatgttgatcgtggcgtaccagaagtatttgactcaatttatgatattcgccagcttttacgtgctatgtactacatgtcagacaagaagaagctagcagatcaagatatgcctcttcctgaaaagcttgccgtaaagacaggaatgagaaagattaaaaagacttgggtagaagaactacttaaagaagcaaatttagtc

SEQ ID NO: 8 - protein, 591 aa, Lactobacillus acidophilus
MYYSNGNYEAFADPKKPAGVDKKSAYIIGSGLAGLSTAVFLVRDAQMKGENIHILEELPVAGGSLDGADRPNAGFVVRGGREMENHFECLWDMYRSIPSLEVPGASYLDEYYWLDKEDPNSSNCRLIYNRGDRLPSDGQYGLGKCANEIVKLIMTPEKEIEGQTIEEFFSDEFFKTNFWTYWSTMFAFEKWHSLAEMRRYAMRFIHHIDGLPDFTALKFNKYNQYESMVKPLLAYLKDHGVQFEYDCHVKNVEVDHEGDSKIAKKIVMTQNGKDKEIDLTHNDIVFVTNGSITESSTYGDQNTPAPITNAKGDSWKLWENLAKQDPAFGHPDVFCENLPERSWFVSATATLENKKLAPYFERLTKRSLYDGKVNTGGIITIVDSNWELSFTIHRQPHFKSQNPDQIVVWIYALYSDTEGNYIKKRIVDCTGKEIAEELLYHLGVPESQISELASEENMNTVPVYMPYITSYFMPRRDGDRPDVVPEGSINLAFIGNFAESPTRDTVFTTEYSVRTAMEAVYTLLNVDRGVPEVFDSIYDIRQLLRAMYYMSDKKKLADQDMPLPEKLAVKTGMRKIKKTWVEELLKEANLV

SEQ ID NO: 9 - DNA, 1770 bp, Lactobacillus acidophilus
  misc_feature (0)...(0): ORF 555 myosin-crossreactive antigen
  CDS (1)...(1770)
atgcattatagtagtggtaattatgaagcttttgtaaacgcaagtaaacctaaggatgtcgatcagaagtccgcatatcttgttggttcaggtttggcatcgcttgctagtgctgtatttttaattcgtgatggtcacatgaagggtgatagaattcatatccttgaagaattgagccttccaggtggttcaatggatgggatctataataagcaaaaagaaagctacatcattcgtggtggtcgtgaaatggaagcccattttgaatgcttgtgggacttgtttagatcgattccatcagctgaaaataaagatgaatcggtcctggatgaattttaccgtttaaatagaaaagatccaagtttcgcaaagactcgtgtcattgttaaccgcggacatgaacttccaactgacggtcaattacttcttactcccaaggctgttaaagaaattattgatctttgcttaactcctgaaaaagatttacaaaataaaaaaattaatgaagtctttagtaaagaattttttgaatcaaacttctggctttactggtcaacgatgtttgcctttgagccatgggcaagtgcgatggaaatgcgtcgttacttaatgcgttttgttcaacacgtttctacacttaagaatttatcatcactacgctttactaagtataaccaatatgaatcattaattttaccaatggttaaatacttgaaagatcgcggcgtgcaattccattacaacaccgttgttgataatatctttgttaaccgttcaaatggtgaaaagattgctaagcaaattcttttaactgaaaacggtgaaaaaaagagcatcgatttaacagaaaatgacctcgtcttcgttactaacggttcaattactgaaagtacaacttatggtgataacttgcacccagcttctgaggaacataaattaggtgctacttggaaattatggcaaaacttggcagcgcaagatgatgacttcggtcacccagatgtcttctgcaaggatattccaaaggctaactgggtaatgtctgctacaattacttttaagaataatgatattgtgccattcattgaagcagttaataagaaggatccacacagcggctcaattgtaactagtgggcctactacgattaaggattctaactggctacttggttattcaatcagtcgtcagcctcactttgaagcacaaaagcctaacgaattgattgtatggctttatggtttgttctcagacaccaaaggtaactatgttgaaaagactatgcctgactgtaacggtattgaattatgtgaagaatggctttaccacatgggtgttcctgaagaaagaatcccagaaatggcttcagctgctacgactattccagcacacatgccatatattacttcatacttcatgccaagagcattaggcgacagacccaaggttgtgccagaccactcaaagaacttggccttcattggtaactttgctgaaacgccaagagacactgtctttaccactgaatactctgtcagaactgcgatggaagctgtatacaccttgcttaacattgatcgtggtgtgccagaagtatttgcatctgccttcgatgtcagaatgctcatgaacgcaatgtactacttgaatgatcaaaagaagcttgaagatcttgatttgcctattgctgaaaagttggcaattaaggggatgctcaagaaagttaagggcacttatatagaggaattgcttaagaagtataagttggtt

SEQ ID NO: 10 - protein, 590 aa, Lactobacillus acidophilus
MHYSSGNYEAFVNASKPKDVDQKSAYLVGSGLASLASAVFLIRDGHMKGDRIHILEELSLPGGSMDGIYNKQKESYIIRGGREMEAHFECLWDLFRSIPSAENKDESVLDEFYRLNRKDPSFAKTRVIVNRGHELPTDGQLLLTPKAVKEIIDLCLTPEKDLQNKKINEVFSKEFFESNFWLYWSTMFAFEPWASAMEMRRYLMRFVQHVSTLKNLSSLRFTKYNQYESLILPMVKYLKDRGVQFHYNTVVDNIFVNRSNGEKIAKQILLTENGEKKSIDLTENDLVFVTNGSITESTTYGDNLHPASEEHKLGATWKLWQNLAAQDDDFGHPDVFCKDIPKANWVMSATITFKNNDIVPFIEAVNKKDPHSGSIVTSGPTTIKDSNWLLGYSISRQPHFEAQKPNELIVWLYGLFSDTKGNYVEKTMPDCNGIELCEEWLYHMGVPEERIPEMASAATTIPAHMPYITSYFMPRALGDRPKVVPDHSKNLAFIGNFAETPRDTVFTTEYSVRTAMEAVYTLLNIDRGVPEVFASAFDVRMLMNAMYYLNDQKKLEDLDLPIAEKLAIKGMLKKVKGTYIEELLKKYKLV

SEQ ID NO: 11 - DNA, 687 bp, Lactobacillus acidophilus
  misc_feature (0)...(0): ORF 1244 - sortase SrtA
  CDS (1)...(687)
atggcaaagaataaacaaaagagtagtgttactacgattttagttagaattgttgcggttcttttgttagttataggtttggtccttatatttaataaacaaattagtaatcaaatgatcaagcataatcaacagtcagctttgacaacactaactaaaaaacaagttgaagcaaatcaaaagaaaaaaggtatgtatgactttagtaaggtgaagtcgatgaatatggggcaagctgcacgatcacaggttaagaaaacttctggagcaattggtgcacttgcagtgcctgatgtaaatatgtatttgccaatcatgcttggtttatcagatgatgcaatgtctacgggcggcggaaccatgcgggcagatcaagtaatggggaaggggaattatccacttgcaggccattatatgactgctaagggtattcttttttcaccacttgaagatgtaaaaaagggacaaagaatctatttaactaatttaaagaaaatctatatttatcgtatttacatgaaaaagattgtagatccatctgcagtttggttagttaataatactaagaaaaatattgtaactttaattacttgtgcggacggtggtactaatcgctgggctattcggggtaatttgattaaaactgaaaaagcaacagatgaaaatttgaaggttttcaaattaaag

SEQ ID NO: 12 - protein, 229 aa, Lactobacillus acidophilus
MAKNKQKSSVTTILVRIVAVLLLVIGLVLIFNKQISNQMIKHNQQSALTTLTKKQVEANQKKKGMYDFSKVKSMNMGQAARSQVKKTSGAIGALAVPDVNMYLPIMLGLSDDAMSTGGGTMRADQVMGKGNYPLAGHYMTAKGILFSPLEDVKKGQRIYLTNLKKIYIYRIYMKKIVDPSAVWLVNNTKKNIVTLITCADGGTNRWAIRGNLIKTEKATDENLKVFKLK

SEQ ID NO: 13 - DNA, 1929 bp, Lactobacillus acidophilus
  misc_feature (0)...(0): ORF 1609 - mucus binding protein precursor
  CDS (1)...(1929)
atgtctctatttggtaaaaagaaaaaagctatcgttaattatatagatttggacaatgataaaaataatatcgctacatcaggtgaattgttaggtaatgttggtgaagagattggttacagtagttcagatcagattgatgctttaaaaaagcaaggttatgttcttgtaaataatagttttgatccgagtgataaaccaactttttcaaatgaagatgttcaaacttatactatttcatttaaacatgatgtagaagcagttgataaacctaattctgattttggaattagtgaaagtgatttacaaaaagtgggtacgcaaactgtccattatgaaggtgctgctactagaacaccaaaagataatgtgagtcaggttgtttttaaacgtagtgtagtctatgataaaatactaaaaaaaatcattagtacttcaacatggatgcctgaaaagcaaagctttttattgatcgctacacctgaagtttcgggatatactactgttcaaactactgtgggtggtgaaacggtaactcctgaagattgtgatcgtaattatgttgttgaatatgatattaatcatcaaccatctgtcgctgatcaaaaagtagctgttaaatatgtcgatcaagatctagaaaataaagaaattactgaagatatattaactggtatgccaaattccttggtagattatgatcctaaagctactattgaaagactcgaaagtgacgaaggatacgctttagtaaataatggttataatcctgcgggtgaagtacaattttatagcaacaatgacgattatgtgcctgtctttgttatgacaatgaagcacactatcggtcaagtagatagtgaacatcctgatagtaaagtaaataagaacgaatatgataaagatgtcgcatttactattaattatgaaggagcagatgctgctactcctgttaacaatgttcaaagatcacactggagtcgtagtttaaccgttgatcgtgttactggtgaaattttacctggaggtaaatatacaactgattggaaagtggatcgtgaaaagtatgatgatgttgatgttccagtagttgatggatatcacaccgatgttaaaatgatcaaaggtgccgaggttacacgagaaaatattattagaacagtaaattatgttgctaatggccatattattccagtggattctgatggtaaagaaattgttggtgcaccacatccagtctttcaaactgatccaaatgatccaactcaagtgattactgatgaaccagtgccaaagattgatggatacaagtgtaatttggcaactattacaccgtataatccagcaaaagatatggaagttaagtataaggcagaagattctgatgttttagtaatttctgttggtgataagaaacccaagtcagaaactaaagcagtttcagtggaaaagccggttgttaaacctgaccctaaaccggaaaatactaattcagtaactcaacctgctgttactcaagatcaaaatcatgatcatgatcaagttgctataattaactttatagatcttgaccatgatggtaaacaactgacctcatctggtccactaactggtaagccaggtgaaagcattaacgatttgtatagtacagaattaccattaaaggcgatcgagcgtgcaggttatcatgttgtctttaatggctttgatgataatggtacaattcaaagatttgacaataatgatttaatgacacaagtgtttacaattggtttgcgtaaaataagtgatgaacagcaaacttcaattggacttgatgcattaaagaaacttgatcttcataataatgaggatgttgctgcaattgcctttggagttgcttcaactatcattagtttaattggattaatcggtaataaaaacgataag

SEQ ID NO: 14 - protein, 643 aa, Lactobacillus acidophilus
MSLFGKKKKAIVNYIDLDNDKNNIATSGELLGNVGEEIGYSSSDQIDALKKQGYVLVNNSFDPSDKPTFSNEDVQTYTISFKHDVEAVDKPNSDFGISESDLQKVGTQTVHYEGAATRTPKDNVSQVVFKRSVVYDKILKKIISTSTWMPEKQSFLLIATPEVSGYTTVQTTVGGETVTPEDCDRNYVVEYDINHQPSVADQKVAVKYVDQDLENKEITEDILTGMPNSLVDYDPKATIERLESDEGYALVNNGYNPAGEVQFYSNNDDYVPVFVMTMKHTIGQVDSEHPDSKVNKNEYDKDVAFTINYEGADAATPVNNVQRSHWSRSLTVDRVTGEILPGGKYTTDWKVDREKYDDVDVPVVDGYHTDVKMIKGAEVTRENIIRTVNYVANGHIIPVDSDGKEIVGAPHPVFQTDPNDPTQVITDEPVPKIDGYKCNLATITPYNPAKDMEVKYKAEDSDVLVISVGDKKPKSETKAVSVEKPVVKPDPKPENTNSVTQPAVTQDQNHDHDQVAIINFIDLDHDGKQLTSSGPLTGKPGESINDLYSTELPLKAIERAGYHVVFNGFDDNGTIQRFDNNDLMTQVFTIGLRKISDEQQTSIGLDALKKLDLHNNEDVAAIAFGVASTIISLIGLIGNKNDK

SEQ ID NO: 15 - DNA, 3051 bp, Lactobacillus acidophilus
  misc_feature (0)...(0): ORF 1377 - mucus binding protein precursor
  CDS (1)...(3051)
atgaaattagcctatgacgattggcgtaaaaataaagaaaagaattatccttttgcgggttacactgtagagattgattcattatcgaatgctccattaacaaatggaggtacctacactatcaatttgggaaccgaaactcgcctttataatgaaccatattgggtaataacttcacgcactattcattatgtaaaatatggtctaaccggttctgatagtgttgcttctccagatgtgatccaggaaggtcattcaaatgtaaccagttctaaaaataatccagtggtaaataactttaatttagaaaaagatggtcatcactatgtgagttatgaaacggttcaaagatcgtataatgtagcttctggtattcctgatgggatgacagataataaaggtaatatgaattctattattatctttgatggacagataaacccaactattactgattgggttactccagatcctgatgtaactcaaaccaaatcaccgggcaagaatctttctaataaaattccaacaaatggtgaatcttacaattacctctatagaaagttctatcatcataactattatgataaagatggtaacttccatcagaagacatatcttcctaataatgaaggagagccaattactattacttactaccacaaccaacctgtagatctttcatttgaagatatttcaaagattgatcctcaagatttaagtgggagcaactattctgctactaacgaattaacgacaaagaacgatgatagtaatcaatacaatgtttacgatgcatcaaatggtactaaaagtttaagtcaagtaattagtgatattgaagcgaaaggttacaagcttgtttcaattactaacgatgacgatgattctcaaaccgacttgaagggcaacagttcaattgatttaatctataacaaagatggtgtttggaagagtgcaactggtggggataatgctgataacttgattcataagcgctacactatcaagtttgttcatgacgtaaaacctacaactaaaaatacttctgtaagccgtaacattcactatgtggctgacgaaggcaatagcaagtatgaagtattgaagaatcctgatactcaaactgttaactttgaacgtactgcttatattgatcaagttactaagcaagaagttattaagaatgcagatggtacttacagtgaattaccagctgacttcaagccaacttggaaagctgttggaactgataactttgataaaatccaaaaggatagatttaacaaggatgaaggtaaggttcctggcgtttgggaaattgaacgtgctaactatgatgatccagagggaactcaattaacggataactttgctcctaaagttgcaaatgttgatgctgctaagacttataatgatatttatcttgtttacaaacaaaaagctcaatataatattcactacattgatgttaatggtgtagaagataaaaacacttatactccaactgacggttatgaacttaccgatcatttagttcctaacgttggtgaaggtaaaggtatctttattggcgacactccagatgctacgcagaagttatggagcccagcagactacgaaaaggctggatatgttttagttggtttatctgataatgccaaaggcgatttactcggtaagcaaaccttaactaaggacgttcaagatcaatacgtttacttgaagcatgcaatcaccccttcaactgataagacacctaaagaagacgtgaaggccgaaactgtcagtcaagtacgtactatttcatatcgggatgctgaaactggtgaaaagattacagatgaattaaagaagtacggtattactgctaatgttcctgacattacgcaaactatcgattatgttcgtgtgcctctttatgatgcatttaagggtatgtttttaggctttgcagcaattcaaactgatgcaaaaggttttgctaagcttgatagtaacggtaaaccagagatcaagaaagatactaatggccaaccaattattgctactcgagatgataaggcatcatgggttccaactggtgaacatactgactatccagaacaaggctcacctgatttaactaagtatgggtatgtaaaggaaagctcattagaacaaaagactaataacaaggatggcgcacaggtagatgctaaagacggtgacccaactcaatccggtggccacgtggatgtttactacttccacgaacaagaagatatcacttatgtgaatccgaagtttaatattgaccaaaaggatcttgaaaagacctttaaaagaacgattatctaccgtggtaccaaagacggtcatacttatgaagatgtaaatggttcaccagatggcactcataagtatgttcagactaccacctttactcgtaaggcgattgtagatgcagtaacgaaaaaagtgattaaatatactccttggacatcaactaaaacaactttagtagaagttatttctaagacacctactgaagtgggttatgacaatgttgatattaaatcagtttctgcacgtactgttgatccagataaggatccagaagatttaggtacaacagttgtaacttatactgtcaacccaactccaacacctgaaccaaatccaggtaatggcggtaacaccagcgatggtggaaatactcctgatggaggctcagaacaaccaaataatcctggtaacaacaatgaagttccaggtaacccgggcggtgacaatgaaacacctaaggaaactccaactcctaaggatgataagactacaccagaaaaaccagatgaacatgacgatttgaaattgaagtcacctgacgaacataaccatactccaaagaaggaagttaacaagacttcaaataatactccacgtagcgaacgctggaactcaaacaaatctcctaaatcagaaaacgtaaataatgtaacaggttctaattccgcagttaaatctaccaatagtcctgaaacagtaaaggaaaatactttaccgcagactggt

SEQ ID NO: 16 - protein, 1017 aa, Lactobacillus acidophilus
MKLAYDDWRKNKEKNYPFAGYTVEIDSLSNAPLTNGGTYTINLGTETRLYNEPYWVITSRTIHYVKYGLTGSDSVASPDVIQEGHSNVTSSKNNPVVNNFNLEKDGHHYVSYETVQRSYNVASGIPDGMTDNKGNMNSIIIFDGQINPTITDWVTPDPDVTQTKSPGKNLSNKIPTNGESYNYLYRKFYHHNYYDKDGNFHQKTYLPNNEGEPITITYYHNQPVDLSFEDISKIDPQDLSGSNYSATNELTTKNDDSNQYNVYDASNGTKSLSQVISDIEAKGYKLVSITNDDDDSQTDLKGNSSIDLIYNKDGVWKSATGGDNADNLIHKRYTIKFVHDVKPTTKNTSVSRNIHYVADEGNSKYEVLKNPDTQTVNFERTAYIDQVTKQEVIKNADGTYSELPADFKPTWKAVGTDNFDKIQKDRFNKDEGKVPGVWEIERANYDDPEGTQLTDNFAPKVANVDAAKTYNDIYLVYKQKAQYNIHYIDVNGVEDKNTYTPTDGYELTDHLVPNVGEGKGIFIGDTPDATQKLWSPADYEKAGYVLVGLSDNAKGDLLGKQTLTKDVQDQYVYLKHAITPSTDKTPKEDVKAETVSQVRTISYRDAETGEKITDELKKYGITANVPDITQTIDYVRVPLYDAFKGMFLGFAAIQTDAKGFAKLDSNGKPEIKKDTNGQPIIATRDDKASWVPTGEHTDYPEQGSPDLTKYGYVKESSLEQKTNNKDGAQVDAKDGDPTQSGGHVDVYYFHEQEDITYVNPKFNIDQKDLEKTFKRTIIYRGTKDGHTYEDVNGSPDGTHKYVQTTTFTRKAIVDAVTKKVIKYTPWTSTKTTLVEVISKTPTEVGYDNVDIKSVSARTVDPDKDPEDLGTTVVTYTVNPTPTPEPNPGNGGNTSDGGNTPDGGSEQPNNPGNNNEVPGNPGGDNETPKETPTPKDDKTTPEKPDEHDDLKLKSPDEHNHTPKKEVNKTSNNTPRSERWNSNKSPKSENVNNVTGSNSAVKSTNSPETVKENTLPQTG

SEQ ID NO: 17 - DNA, 12978 bp, Lactobacillus acidophilus
  misc_feature (0)...(0): ORF 1392 - mucus binding protein precursor Mub
  CDS (1)...(12978)
atggtttcaaaaaataatcgtgcaaagcaaatggaaaatgttgcagagcgccaaccacattttagtattcgtaaattaacgattggtgctgcttctgttcttttgagtacaacactttggatgagtgtaaatacaagtagtgtgcatgctgagaatattgataacagtgacaatgatgcacatgaagctacagagagcaatactgaaacgccgagcattaatgatgatacaaaagtagttgttgaatcaaacagcaatataacttcttctaacgatgtaaatgctggtaataatggagcagaaactaatgatactaataatgaagtaactgcttcagaagatactagcaagggattaactgttgataataaagatgcatctgttcaatctactgttaagtcatcagatgaagtaaaaaagagtgaatcaactgagcaaaaatcagctaaaacagctcaaaattctactttaaataacaatacagtaaatacagaaaaagcagaatcaaatgtagctgctaaaagtaatgcagatacagcaaagtctactcaacagagcagtgcagcttcttctgctaatcaagttagttccaatgctgatttaacacaaaatcaggcaattaactctactactcaagttgaagctaataattcaactaatgataaaaaggctaataacgatactgctgatttgagtaatattggcttaaagggaattgaaactaataagattccggaaactactgatttgcctgtaagtgagttgattaaatcttataataacaactctaacagtaatgaagttaatgttaaccaagttagtggcttacgtgctgctcaattatttgctgcttcatttattgcaacacaaaacactggaacaggtaataacggtgcagtaaatattgatacatataagcctgactttaatctcaccgaaaatccagcctatcagcaatattttgcagcaattccggctgatcaatatgcatttcaatcttatgaagtagtaagtactggtcaaaagattgtagttacaacagatcgtaataatattggtaacaatattagattctacaatgttagaaatggtagtgctcaacttgtttaccaaatgaccagagatacccagaccaatgcaagtggtagtgtagtaaaaaatagaccaagtttacaaggtacttttaccactgctggtgttgcaagtaattcaacatataagggcggtacctataactggtctcttaaccaaacagacactgtaaactttcctggaattggtaatttgaagattgggcgtattgacattactgctggtagtagtaattctccagtagacaatggtacaggtgcttttgtaaccgataattctcatcgaattacacctacttgggatcaaggtcttccaatagaaggtattgtttcaggaaagacttggaatagtgcaggttccaacatcccagataaagttactcaaaatatttggtatgttgatgctgaaacaggtaaagttcttagtcataagactagtgacgaagctttcaatggctctagttatgattcaactgataatggcgtgaaaacaattagtaaagacggtaaagcttatcagttaattgatagaggctctgatgggctttatgatccaagtgactttagtgatattttaaataagcaattagctactaataatggtttaccaattactattggtgatgttctatctactcctcttaaaggaactttacgtgatggtcgaattggtaatattaaaggttctattactaattttcaaggaacgcgcgcatatatgcgtctccaaacaaagactgacggaactattgatttaaacacttatacttttgatccaggttctactagaggtaacttgaatactggattaagtcaagctgatgttgctccaggccaaacagttatgggtgctggtgacactagtggttcaggggccttctacaatggtactcgcccaggcaatcgtgatattatctttctatataatgctgaagcaaacaagcaaaatgctaacattactttcgttaacgatgatactggtgcaagtttaagtccacaacaaaattctagtggggatgcaggtagtcaaatcacctttgacaatgcaggtactactgttactaacttgattagccaaggttacgtttacaacggtacaactggtaatggcgtaactaatggatcagctggtggtagctttactagtgttggttttccagcttacgataacgatgacaacaccaaccaagcatttgttgttcactttaagaacccagtacaaactactacttaccgccaaggtactgaggaatctaagaccatcaatcgtacaattaactactatgataaggtaactggtgaaaagattccatctaacttaatttcacaaaacccagttactgattcagtaactttcactcgtactcaagttttggatcaagatggtaaggttgtaggttacggtactatttcaactgatggtaaatcatttagaaatcaagattggcatactgctgctggtgaaagtagtactcaatttgatgctaagcgttcaagtgatcttagtgcatataactacactgctcctgaattccaagatggaactaatgcaagcattgtagcagctcatgaagtgactccaactactcaagatctcgtttacaatgtttactacggtcaccaaactcaacaagtaactactaatgaagatgtaacgcgtcgtttccactacatctttactgatggcactacgccagaaagccatttaactcctcaagcagatcaaaaagtaacctttactggaactgctactaaggacttagtaactggcaagaccggtgatactgtttggactccatcgactggtacattagctcaagttgctggtcaaactgttgccggctaccacattactggtaacgtaaatgctaacgctgatggtagtgcgaatgccgttacggtaaacccagattctggcgatattgatgtaactgttgtttacactccagatgctaagactccagatactccacaaaaagctaaggttactatttacgataagactgaaaataataagcaattatctaattttgaaaataacaatggtacaaagggtagtgcaatcagctttgacggtgaaccacaaacccttcaagcttacttaaattcaggctacgtatttgatagtgcaactgatgccaatggtaattcaattggtactgcctcaaacattacctttggaaactttgatagtgttgatggcaatgttcaaagctttaacatttatttggttcacggaactgatactaagactgaaaaggcaacgactaatgctcatgttcactatgttgtagcaggcaacgaagctaataagccagctgctccggcagatagtccaactcaaacaatcaactggaccagaactaacactactgacaaggttactggtgcaactactgaaggaacttggactccagacaagaacggttttactagtgtaacttcacctgatcttactaattacactccagatcaagctgttgctaactttactacaccacagcctaaccgtgatcaagtagtaactgttgtatataatccaaatccagaagttgctcaaaaagctgacctagttgtttatgacaagactgataataataaggaacttaacaacttcgataatagtggtaaaactggtactcaaatttcatttagtggttctgcaaattacgttgctgacttaattgctaaaggttacaagattgatagttttgtaaatgatcaaaaccaaacttctaacccaacttcatatgatcaaatcagtttcagtaacttcgataataatagtgctagtgaccaacactttaagttgtacttagttcacgatactgaaaacgtaacagataagaagactactacttcaactgttcactacgttgtttcagatggtaagactaacccaccatctgataatactcaaacgattacttggactcgtccaggaactaaggataaggtcacaggtgtaacaactccaactggaaactggactactccggacaactatacggatgtaccaacgccaaatcttgatggatacactccagataagactaatgttccagcaccaactccagatccaaatcaaaacccaacaactgttgttacttacaatcctaagactccagaagcaccaacttacacgggtactaccgagaataagactgtaactcgtacaatcaactactatgacaaggtaactggtgaaaagattccagctaacttaattagtgataatccaacaactcaaaacgtaactttatcacgtactcatgttgtttcatcaactggtcaagacatgggctatgggactgttagtgctgatggtaagacatttactaaagcgacaactgttgatggttggaacactggtgactgggctcaagtaacttcaccagatctttcaaacgcagggtacactgctccagatttagctcaagctgatcaagtaactgttgatgcaaacactaaggatgctgtggttaatgtttactacggtcaccaaactgaagtaattacaccaaagactccacataatcctggtggaagtattaaccctaatgatccacgtaataagccatcagtttacccagatggtttaactaaggaagctttaactactgaagtaactcgtcacattaactatgttggtgtgaatgaagacggaactactactccagtaaatggctcaccagatggtaagaatacttatactcaaaccgtttcctttgaacgtaatgccgtgatcgataaggtaactggtcaaattttgggctacagtactgatggcactactaatgtaactataactgataaggaccgtgcttggacgccaacaacccaaaacatggattctgtagcttctaagactcctagtgaagtaggctatgacaaggttgacatttcaactgttgggggcgtaactgtttacccaggtcaaaaagttaacgatgtaactgtcacttacactaagaacaagtcacctgaagttactcaaaaggccactcttgaaattatcgataacaacgatactaacgcacctaagcaattagcttcattcagtaatgaaggtaagagtgaagatcaaattaacttcgctaactcaaatgaaatccttcaaagttacttaagccaaggctacaaggttcaaaagactgctggtaaccttagtggagatgctcaaagtggctacacttaccctacttacggtaatactacgcaagacttcaagatttacttgattcacgatattgcagataagactgaaactgctacagcaactgctcaagttcactatgttgttgctgataatggtgtacaagctccagcagatagtgatcttcaaactattacttacactagaactaatagagttgataaggtaactggcgcaactgtaaatgaaggtacttggcaagctgataagagtgtctttactgatgtaaaatcaccagatctttctaaagatggttacactccgagtcttgaaaatgttcaatttaatgctccagagcgtaatgtaaaccaacgtgtaactgttgtttacaaccgttctgctcaagctgctgatttacaaatcattgacgacaatgatccacaaaaccaacgtgtattggcaacttactcagcaggtggcgaatcaggtaagcaaattagctttgatggttcaaacactcaacttcaaacttacttgaacaatggttatacatttgaaaagtatgaaggtcaaggtatgagtggggatgcccaaaatggcttcacttacccaagctttgataatgattctcaatctaaccaaagcttcaagatttacttgaaacacgcaactgctaataagactgcaactgcaactactactgctcatgttcactacatcatggcagatggtactaaggctcctgatgatagtgcaattcaaactattaactggacgcagactaacactgttgaccgagtaactggtgcaactataaatgaaggtacttggtcttctgataagaatgcttttactgatgttgattcaccaacagtaactgggtacactccaggtactaagactgtaaaatttgctactccagaacgtggtgttaaccaagttgtaaatgttgtttacactaaggatgctccaactccagatcgacaaaatgctttggttgtttaccaagacgtaaatgatccagctcatccggttgatttaggtcaaagtgatcaattaactggtcaagcaggctatagcattaactacagcactgctaataagattgatgaatacgaaaaacaaggttacgtattagtatcaaacggctttgatgcaaatggtactaagccaagctttgacaatgttaacggtaatactcaaacattctatgtaacctttaagcatggtattcaacctgtgacgccaacaactccaggtactccagatcaaccaatcaatcctgataatccagatggtcctaaatacccatcaggcactgatcaaactagcttaactaaagatgtaactcgtactgttacttacgaaggtgctggcaaccaaactccaagtcctgtaactgatactcttcacttccaaggtacaggttacttagacaaggtaactggtaagtggactgatgcaaatggtaagaaattaagtgatcaaactaaggggattacttggacgattaccgatggtactaaggatgaaggtagttttaacttagttccaactaagcatattgatggttacacttccaaggttgtgactaacggtgctgacgatggtaacggtaatgttaagagctacactggtattactcatacaagcgacaatattaacgtggtagttcaatacaacccaattgttgctgaacaaggtaacttaattgttaagttccatgatgatactgataacaaggatttgacaggtgtaggtactgatactggtactcaagatgttggtactcaagtcacttacaatccaagtactgatttaactaatcttgaaaataagggttatgtttatgtatcaactgatggtaatattccttcatcaattgttaaggggaccactactgtaactatccacgtaaaacatggtactgttccagtaactccagacaatccaggtactccagatcaaccaattaaccctaacgatccagatccaaatggtcctaagtatccaacaggaactgataaggcttctattgataagactattactcgtattgttcattacgaaggtgccgatcaatatactccaaatgatgttaagcaaccagtacacttcactgctaagggcgtgcttgacaaggtaactggtgaatggattactccattagcttggtcagaagatcaaacatttaatggtgtaaatagtccaaaaattccaggctaccatgtagaaagtgttgataaggatacaactgataatcaaaacgttgatagtgctaagattagccacacaggggctgattacacagtaactgttaagtatgcaaaagatgctgctccaactccagatgctacaactggaaaagtagcttacatcgatgatactactaagaatactttaaggactgattcgcttagtggtaatgttgatgctaatattgattacactactcaagataagatcagtaattacatcaacatggggtacaagttagtatctaacaacttcactgatggtaaggaaatctttaataaggatgcttctaagaacagctttgaagttcacttggtacatgacaccgttccagtaaccccagacaatccaggtactccagataagccaatcaaccctaacgatccacgtccacgaagtgaacaacctaagtatccaactggtactagtgaaactgaccttactaaggacattactcgtactgttcattattcaggtgctgatgaatacactccaaatgatgttaagcaaccagtacacttcactgctaagggcgtacttgacaaggtaactggtgaatggattactccattaacttggtcagaagatcaaacatttaatggtgtaaatagtccaaagattccaggctatcatgtagtaagtgttgataaagatgctgatggtactaatgttgcttcatctaatgttagccacactggttccgattacactgtcaatgttgtatatgctaaggatgctgtaaagcaagctgaaaatgctaacttacatattattgaccttagcgataacaacaaagaaattgctaactttaatgattctggtgatgataatgctgcaattaacttcaatggcgcacaaactactgtcgatgccttgatcaagggtggttataaagttaacagcattgttcaagcaactagtgatcctaataacccaactaaatatggcactgaatattcaagtgctgctagtcaatggatgtttgacgataaacctggtgtagatcaatcattctatgtatatgtagaacacgattacgctccaattaatccagaaaatgcctatggtagaactgatttaactcaaacagtaactgaaactgttcactacattgatgaagctactaataagcctgttgcaactgattacaccaatactcttacatttaagggtcaaggtagagttgataaggtaactggtaagatgcttaagatcaagagcattgaaaatggtcaaattacttatgattacaatgtagccaatgaaattgatatcagtagtgctaagttaagtgactttgcttggtcaactccgactactttgcaaaaagtaacttcaccaactattgctggttacacaattgatgctgctaagactacaccaagtgaattagctgatggtaatgacattaaggaaatccaaaatgttgcttacgatcacggtaacgtagaagctactgtttactacaaggcaaacccagttgaaactcacaaggctggattaactatttatgcaaatggaaatcaagtaggtactgcgagtgtaactggtgctaaggatactgctattaacttcagtagtgcttctgatattgttgcggcttacatttctaatggttacaaatttgatcacgctcaagatgtaaccaacaataaagaaatgactggtaagtcatacaatgagttaaactttggtaactttgcaactacaaataatagtgatcaacaatttgctatctacttaactaaggatgaaacaccagctaagactcaacaaaatgctcaattgactgttcgagatgtaactcctggtcaagaaatggatttaggtaattacactcaacctggtcttgaaggcgatacaattagctttagtagtgctcaagaatttgttcaaaacttattgaacaaaggttacgtttgggatggtgcttcatataacggtactaacttagaagctactaactatgctggtattaactttggtaattatgacaacactgatgataagaatggcattagtcaaaaatgggtaattaacttagttcatggtgtaactccagtaaatcctgatcatccagatgataaagatggttttactaaggattaccttgatcgtacaattactcgtgatgtaacttatgtttacgaagatggtagccaagctgctgctccagtacatcaggaagcacattaccaaggttcaggttacttagataatgtaacaggcaagtgggtaactgttgaaaatggtaagatcactggcttggctcaaggcttaacttggactccagatcaagattcaacatttgaccaaattggtgcaaagaatattgaaggttaccatgtatcttctgtaagcggcaatggaatttcaggcttcacagttggtcaagatggtacagttggtcaacaaacagttactaaagatactccaagttcaacaattagagttgtttatgttaagactccagtaactccagttccagcaaatggttcaattgtttacattgatgacactactggtaataaccttgagaatgctactttcggtggtactgttggtgctaagattgactacactactgcagatagaattagttactatcaaggtaaaggctacaagcttgtatctaacaacttcaccgatggcagccaaacattcaaacaaggtgaaaataagtttgaagttcatttaactcatgtgactgaaactaaggatgcaactaagactattactcgtgatgtaacttatgtttacgaagatggtagtcaggctgatactccagtacaacaaacaattacatttactggtaaaactactagtgataaagtaactggatctgaaaagactacttggaataatgaaagtcaaaccttcggtgcaactaaagcaattgatacaactaagtatcaaattgtaggtattaacgaacgtaatactactgccaatgttgacagagatactggtgtagtagctagtgaaacaattactccaaatagtcaaaatagtgcagttgtcatcactttggcaaacaaaccagaaactccaattccagcaaatggttcaattacgtattatgatgatactactggaacaactcttgaaagcgctggtttcagtggtagtgttggacaaaagatcaattacactactgcggatagaattattaattacgtaaacaagggttatgatgttgtatccaacaacttcactgatggcaacgaaacattcaaacaaggtgacaacaagtttgaagttcatttggtacatgcgactacaccaattacccctgaaaatccgggtaagccaggtcaagaagttccaaatccaaatgatccagaacacccacacactattcctgccaactttgtaccacaaactttgactcatactgtaactcgtgatgtaacttatgtttatgcagatggtagtcaagctagtgctccagtacatcaaacatttacctttaacggtaacggtgtaattgatcttgtgacaggtcaattagtaactgttgaaaacggcaagatcactggtgcaggtaagattacttggaatgcagacagtcataacttcgatgcaatcgatgcaattgatcacgatggttactacatttcaaatgttagtgaaaataacactacagctaatgtagatacaaatacaggtgcggtagctggtgaaacaattactccaaatagtcaaaatagtacaattattattactttgactaagaaaccagatgtaccaactccagttccagagcaaggttcaattaaagtaactgttcatgatgtaaagactaaccaagatgttccaggctatgataaagatagtggcaaacaaaatactggtacaagctttacttatgataaaaccactacaattactgatcttgagaacaaaggttacaaggtaattaatcctaatgttgatattccaactaaggtatctaatattgatcaacatattgttatctatgtagatcataatgtgattccagtaactccagataagccaggcaatggattaagtgaaaacgatcttaataagacggttaccgaaactgttcactatgttgtaaacggtggtgctactgaagctccagcagataaaacaactagtttgaaatttactggtacagcttattatgattcagtaactaagaagtggactgatgcaaacggtaatgaattatcagatcaatctaagaatgttacttggactgctgaaaatggtaataagtttgcagtagtggtaactccaactcttgaaggttatactccaagtgttcaatctggttatgatgatggaaataagaatgttaaggaaatcaataacattactccagattcaggtaatgtagaagtaactgtaacttacaataagaacaatgttccaactcctgtaaagcaaggaacaattgagattatttaccatgacactactgataatgtagatattccaggatatggtcagagtcggattaaggaagatgagggtacaagctttagctataatcctaatgctaaagatttaccggccttggaaagcaaaggctatgttcttgatggtgaattaccaacaattccaactaaatttacagatggtgatcaacgtgtggtaattaatgtaaagcacggtacaactactgttactccagataaaccgggcaaacctggtgatccaattgatcctaataatccagatggtcctaagtatccagaaggtaccggtgaaaataacttaaaggtaactggtacacaaactatccattacattggtgcaggtgataagactccaaaggataatactcaaagcttcgaatttactaagcaaattacctttgataatgtaactggtaagattattaatgattctggttggaatgtaaccagtcatacatttggctctgaagcaactcctgtaattgatggctaccatgctgataagacaactgctggaggcactactgtaactcctaatgacttacataagacagtaacagtaacttacacaccaaatgttccggctgtaccgacaccaactccaacacctagtccggaaccaaagccggagaatactccagttgaaccaaatacaccaactccaactccagatattccagataatgtaaccccaactccagaaccagaaaataataatgtaaaacctcatggcgaaagcattgttcaaaagaataatgacaatccaaaggtggtttcacatggtcaatctggtaataattggacagctcctcatggtcaacatgtcgatcaaaggggtaacattgtaacttctgataatagagtcgttggttatgttgatcaaaatggtaaagctcactacactaaattgccacaaacaggcgatgatcaaactaatgatgttgcagcagcacttttaggtggcgcagcagtctcacttggtttaatcggacttgcaggtgtcaagaagcgtagaaaagaagacaaa

SEQ ID NO: 18 - protein, 4326 aa, Lactobacillus acidophilus
MVSKNNRAKQMENVAERQPHFSIRKLTIGAASVLLSTTLWMSVNTSSVHAENIDNSDNDAHEATESNTETPSINDDTKVVVESNSNITSSNDVNAGNNGAETNDTNNEVTASEDTSKGLTVDNKDASVQSTVKSSDEVKKSESTEQKSAKTAQNSTLNNNTVNTEKAESNVAAKSNADTAKSTQQSSAASSANQVSSNADLTQNQAINSTTQVEANNSTNDKKANNDTADLSNIGLKGIETNKIPETTDLPVSELIKSYNNNSNSNEVNVNQVSGLRAAQLFAASFIATQNTGTGNNGAVNIDTYKPDFNLTENPAYQQYFAAIPADQYAFQSYEVVSTGQKIVVTTDRNNIGNNIRFYNVRNGSAQLVYQMTRDTQTNASGSVVKNRPSLQGTFTTAGVASNSTYKGGTYNWSLNQTDTVNFPGIGNLKIGRIDITAGSSNSPVDNGTGAFVTDNSHRITPTWDQGLPIEGIVSGKTWNSAGSNIPDKVTQNIWYVDAETGKVLSHKTSDEAFNGSSYDSTDNGVKTISKDGKAYQLIDRGSDGLYDPSDFSDILNKQLATNNGLPITIGDVLSTPLKGTLRDGRIGNIKGSITNFQGTRAYMRLQTKTDGTIDLNTYTFDPGSTRGNLNTGLSQADVAPGQTVMGAGDTSGSGAFYNGTRPGNRDIIFLYNAEANKQNANITFVNDDTGASLSPQQNSSGDAGSQITFDNAGTTVTNLISQGYVYNGTTGNGVTNGSAGGSFTSVGFPAYDNDDNTNQAFVVHFKNPVQTTTYRQGTEESKTINRTINYYDKVTGEKIPSNLISQNPVTDSVTFTRTQVLDQDGKVVGYGTISTDGKSFRNQDWHTAAGESSTQFDAKRSSDLSAYNYTAPEFQDGTNASIVAAHEVTPTTQDLVYNVYYGHQTQQVTTNEDVTRRFHYIFTDGTTPESHLTPQADQKVTFTGTATKDLVTGKTGDTVWTPSTGTLAQVAGQTVAGYHITGNVNANADGSANAVTVNPDSGDIDVTVVYTPDAKTPDTPQKAKVTIYDKTENNKQLSNFENNNGTKGSAISFDGEPQTLQAYLNSGYVFDSATDANGNSIGTASNITFGNFDSVDGNVQSFNIYLVHGTDTKTEKATTNAHVHYVVAGNEANKPAAPADSPTQTINWTRTNTTDKVTGATTEGTWTPDKNGFTSVTSPDLTNYTPDQAVANFTTPQPNRDQVVTVVYNPNPEVAQKADLVVYDKTDNNKELNNFDNSGKTGTQISFSGSANYVADLIAKGYKIDSFVNDQNQTSNPTSYDQISFSNFDNNSASDQHFKLYLVHDTENVTDKKTTTSTVHYVVSDGKTNPPSDNTQTITWTRPGTKDKVTGVTTPTGNWTTPDNYTDVPTPNLDGYTPDKTNVPAPTPDPNQNPTTVVTYNPKTPEAPTYTGTTENKTVTRTINYYDKVTGEKIPANLISDNPTTQNVTLSRTHVVSSTGQDMGYGTVSADGKTFTKATTVDGWNTGDWAQVTSPDLSNAGYTAPDLAQADQVTVDANTKDAVVNVYYGHQTEVITPKTPHNPGGSINPNDPRNKPSVYPDGLTKEALTTEVTRHINYVGVNEDGTTTPVNGSPDGKNTYTQTVSFERNAVIDKVTGQILGYSTDGTTNVTITDKDRAWTPTTQNMDSVASKTPSEVGYDKVDISTVGGVTVYPGQKVNDVTVTYTKNKSPEVTQKATLEIIDNNDTNAPKQLASFSNEGKSEDQINFANSNEILQSYLSQGYKVQKTAGNLSGDAQSGYTYPTYGNTTQDFKIYLIHDIADKTETATATAQVHYVVADNGVQAPADSDLQTITYTRTNRVDKVTGATVNEGTWQADKSVFTDVKSPDLSKDGYTPSLENVQFNAPERNVNQRVTVVYNRSAQAADLQIIDDNDPQNQRVLATYSAGGESGKQISFDGSNTQLQTYLNNGYTFEKYEGQGMSGDAQNGFTYPSFDNDSQSNQSFKIYLKHATANKTATATTTAHVHYIMADGTKAPDDSAIQTINWTQTNTVDRVTGATINEGTWSSDKNAFTDVDSPTVTGYTPGTKTVKFATPERGVNQVVNVVYTKDAPTPDRQNALVVYQDVNDPAHPVDLGQSDQLTGQAGYSINYSTANKIDEYEKQGYVLVSNGFDANGTKPSFDNVNGNTQTFYVTFKHGIQPVTPTTPGTPDQPINPDNPDGPKYPSGTDQTSLTKDVTRTVTYEGAGNQTPSPVTDTLHFQGTGYLDKVTGKWTDANGKKLSDQTKGITWTITDGTKDEGSFNLVPTKHIDGYTSKVVTNGADDGNGNVKSYTGITHTSDNINVVVQYNPIVAEQGNLIVKFHDDTDNKDLTGVGTDTGTQDVGTQVTYNPSTDLTNLENKGYVYVSTDGNIPSSIVKGTTTVTIHVKHGTVPVTPDNPGTPDQPINPNDPDPNGPKYPTGTDKASIDKTITRIVHYEGADQYTPNDVKQPVHFTAKGVLDKVTGEWITPLAWSEDQTFNGVNSPKIPGYHVESVDKDTTDNQNVDSAKISHTGADYTVTVKYAKDAAPTPDATTGKVAYIDDTTKNTLRTDSLSGNVDANIDYTTQDKISNYINMGYKLVSNNFTDGKEIFNKDASKNSFEVHLVHDTVPVTPDNPGTPDKPINPNDPRPRSEQPKYPTGTSETDLTKDITRTVHYSGADEYTPNDVKQPVHFTAKGVLDKVTGEWITPLTWSEDQTFNGVNSPKIPGYHVVSVDKDADGTNVASSNVSHTGSDYTVNVVYAKDAVKQAENANLHIIDLSDNNKEIANFNDSGDDNAAINFNGAQTTVDALIKGGYKVNSIVQATSDPNNPTKYGTEYSSAASQWMFDDKPGVDQSFYVYVEHDYAPINPENAYGRTDLTQTVTETVHYIDEATNKPVATDYTNTLTFKGQGRVDKVTGKMLKIKSIENGQITYDYNVANEIDISSAKLSDFAWSTPTTLQKVTSPTIAGYTIDAAKTTPSELADGNDIKEIQNVAYDHGNVEATVYYKANPVETHKAGLTIYANGNQVGTASVTGAKDTAINFSSASDIVAAYISNGYKFDHAQDVTNNKEMTGKSYNELNFGNFATTNNSDQQFAIYLTKDETPAKTQQNAQLTVRDVTPGQEMDLGNYTQPGLEGDTISFSSAQEFVQNLLNKGYVWDGASYNGTNLEATNYAGINFGNYDNTDDKNGISQKWVINLVHGVTPVNPDHPDDKDGFTKDYLDRTITRDVTYVYEDGSQAAAPVHQEAHYQGSGYLDNVTGKWVTVENGKITGLAQGLTWTPDQDSTFDQIGAKNIEGYHVSSVSGNGISGFTVGQDGTVGQQTVTKDTPSSTIRVVYVKTPVTPVPANGSIVYIDDTTGNNLENATFGGTVGAKIDYTTADRISYYQGKGYKLVSNNFTDGSQTFKQGENKFEVHLTHVTETKDATKTITRDVTYVYEDGSQADTPVQQTITFTGKTTSDKVTGSEKTTWNNESQTFGATKAIDTTKYQIVGINERNTTANVDRDTGVVASETITPNSQNSAVVITLANKPETPIPANGSITYYDDTTGTTLESAGFSGSVGQKINYTTADRIINYVNKGYDVVSNNFTDGNETFKQGDNKFEVHLVHATTPITPENPGKPGQEVPNPNDPEHPHTIPANFVPQTLTHTVTRDVTYVYADGSQASAPVHQTFTFNGNGVIDLVTGQLVTVENGKITGAGKITWNADSHNFDAIDAIDHDGYYISNVSENNTTANVDTNTGAVAGETITPNSQNSTIIITLTKKPDVPTPVPEQGSIKVTVHDVKTNQDVPGYDKDSGKQNTGTSFTYDKTTTITDLENKGYKVINPNVDIPTKVSNIDQHIVIYVDHNVIPVTPDKPGNGLSENDLNKTVTETVHYVVNGGATEAPADKTTSLKFTGTAYYDSVTKKWTDANGNELSDQSKNVTWTAENGNKFAVVVTPTLEGYTPSVQSGYDDGNKNVKEINNITPDSGNVEVTVTYNKNNVPTPVKQGTIEIIYHDTTDNVDIPGYGQSRIKEDEGTSFSYNPNAKDLPALESKGYVLDGELPTIPTKFTDGDQRVVINVKHGTTTVTPDKPGKPGDPIDPNNPDGPKYPEGTGENNLKVTGTQTIHYIGAGDKTPKDNTQSFEFTKQITFDNVTGKIINDSGWNVTSHTFGSEATPVIDGYHADKTTAGGTTVTPNDLHKTVTVTYTPNVPAVPTPTPTPSPEPKPENTPVEPNTPTPTPDIPDNVTPTPEPENNNVKPHGESIVQKNNDNPKVVSHGQSGNNWTAPHGQHVDQRGNIVTSDNRVVGYVDQNGKAHYTKLPQTGDDQTNDVAAALLGGAAVSLGLIGLAGVKKRRKEDK

SEQ ID NO: 19 - DNA, 3624 bp, Lactobacillus acidophilus
  misc_feature (0)...(0): ORF 1709 - mucus binding protein precursor Mub
  CDS (1)...(3624)
atggataagaaagaagtgaaaaataggtttagttttaggaagttatccacaggcttagcgacagtatttttaggatcaattttcttttggacaaatggacaaacggttcaagcagatagtgtagagccagctagtgaacaggctgtacaaaatgttgactctcaagtacaggctgataatactgtttcggaaaataccgttaatgaagaaaatggctctacttccgaaactactactgaagttaagacagaaatgccgtctgttgatacaacatctcaagctaaagatgcagtagaaacttcagataataagaaagttgagctccctcaaggagaagcagataagcaggttccacaaaagttagaggttaataagagtaatcaagcagctgaaacaactgataaagatacaaagcaaaatgctacttctgcaacaccagcacaacttaatgaaaatacagctccagttgttgtaaaagctaagtcggaaggaaaagaagtagttaaggctactgatccgactgattatccaactgaagttggtcaaatcattgatcaagataaatatatttatcaaattttgtcgcttaatgatcgtagtggccgaccttctgattcgaagctggttcttaccactaatagaaatgatcataatgacaagaatatctatgcttacgtagttgatagaaataatagaagagtaagtcaatcagttacagttggtgtagatcaacatactattattagtgtgaatggtcgcggatatcaaatttctaataccggcggtagcaatgtcattgtagatggcaaagaagtgccaacgcagaatacttctactgttacttcgggtaatggtactactagtccaatctatggattaggtaatactactcgtggtgattattccgcaattggtgaaatcccaccagtatacactgaaaattcagtaatcaagtattactatcgtgatgaaaatggtaatttaaaagaagctgaaagttctgatcagtatcctaacgtaaacgtttcgggtcttactggtcaagaatttgtaattcctaatgtggatcaatataagcgggttatcaagggacgttatttaaattcagataatttgcctacaggtgatttcacgggaacgatttctcaatttggtgaggggaaatattataagaaagtctactatgattatggtacagatgatgtggattattacgtagtatataaccaagtttcacctgacggcacaatggatgttagtctctttagaggtgacaataatacacctattgaatcaagaagggtgggtccaggtagatctattcgttttaccagtcgtaactatactgctcgtaatccatatgtgaccgaaacaccacatgaagtacaatttatttacgataaattaggttccattgttccagtcgatgaagatggtaacgtaattggcgacttagtccaattcaataatagtactgatccaactaaggctgctgtaaccgattcgccagttattgctggttatacaattaaggatcctactcaaagagagattaccccacatgatcctggcaaaaatattaaggtagtctatgttcgcaaccatgtgacagcagctattaagtatatcgatgatactgctggcgatgacttaagtgcgtacaacaagtcaattacagctaagccaggtgaagcacttaactatactactaaagattcaattacagaactccagaataaagggtatgtattagtaagtgataacttcaatgtaactactatgcctgaaaatggtggtaattacgaagttcacgtaaagcatggcactaagacaatcgatccagataacccaactgataagtacaccaagaaggatttacaaaaaacagctactcgtacgattaattatgttgatgatcaaggcaacaagattgcagaatctgtgacttccacagttgttttcacagggactggtactgtagatgccgtaaccggtaacttagtgaacttacatcccgacggttcgattaaagaccaaaacggtaagcttacttggacttactcagttgatggcggtgttgtacaaaaaagtgatacttacacatttagcgcaacaactgctcgaccaactattgatcacaataattctacttacaactttacttctactactcccgctgattacaatgctggcaatggtgctgtatcgagttatcgtgtgaatagtactgatccacaaaacttaattgttaatgttgtttataccaagcaagctatctaccatgcaggtaagactgaaactaagagtgtaactcgcaccattaattatttagatggtaagactggcgaaaagataccaactgatttaattgcaactaacccagttgcacaaacagttaatttgcatcgtactgaaattattgatgacaacggcaaggtgatcggctacggtacaatcagtaaagatggtaaatcatacactattaacaatgattgggtagtcgacggtaagtgggcaagtgtaacttcacctgatttatcagctaagggttataaagctccacgttttgaaaatggtacttcagctgctagagttgacgaagtaattgttggtagtggtaccaaagacgctactgttaatgtttattacgatcataatttgatcccaattggaccagataattttgataagcatggcgtagatcgaagccagattgagaagcaggttaaagaaacagttcattatgtaggtgctggcgataagactcctgctgatcatgtgcaaacttcgaagtggacgcgcactattactattgatgcggtaactaaagaagttgtacctaatggtcaatatacaactgattggacaattccaaagggtgagaagaccgagtatgctcaagtaaatacgccagtagttaatggctactatgctgatcaagctaatgttccggcaacgactgtaactcaaaatgatattgaaaaaacagtaacttataagcaaattggtaggattgttccagttgatccaaatggtaagccaattccagatgcaccaactccacaatatcctaacgatccaacggatccgactaaggtacttcctaatgtaccggtgccaaatattccaggctacaagccaagtgtgccaacagttactccaactgaccctggcaaggatacacaagttccatatacaccggtaactccaactaatccagataatccagtcattccaacgcctcaaccggaaccaaaccctgataatggtaaggataagccggtcgatccatccaagccatcagatgatccagttcatcctgaatatcctggtattaagaggggacaggataaacctgataaggaaaagactgataagaagagaaatggcaagactaagggtaaagaaaatacacctactggaagagatgctgttaagcgagctggacgaagcgatgatgcacttaaattagctagtgaagctaaaaatcgccgtatgactattcaaggtaagaatgaagaattaccacaagctggtgaagatcataatgctatggcgttgattggtcttgcatttgccactcttgctggaagtgtagtctttgctactgataggaaacggaga

SEQ ID NO: 20 - protein, 1208 aa, Lactobacillus acidophilus
MDKKEVKNRFSFRKLSTGLATVFLGSIFFWTNGQTVQADSVEPASEQAVQNVDSQVQADNTVSENTVNEENGSTSETTTEVKTEMPSVDTTSQAKDAVETSDNKKVELPQGEADKQVPQKLEVNKSNQAAETTDKDTKQNATSATPAQLNENTAPVVVKAKSEGKEVVKATDPTDYPTEVGQIIDQDKYIYQILSLNDRSGRPSDSKLVLTTNRNDHNDKNIYAYVVDRNNRRVSQSVTVGVDQHTIISVNGRGYQISNTGGSNVIVDGKEVPTQNTSTVTSGNGTTSPIYGLGNTTRGDYSAIGEIPPVYTENSVIKYYYRDENGNLKEAESSDQYPNVNVSGLTGQEFVIPNVDQYKRVIKGRYLNSDNLPTGDFTGTISQFGEGKYYKKVYYDYGTDDVDYYVVYNQVSPDGTMDVSLFRGDNNTPIESRRVGPGRSIRFTSRNYTARNPYVTETPHEVQFIYDKLGSIVPVDEDGNVIGDLVQFNNSTDPTKAAVTDSPVIAGYTIKDPTQREITPHDPGKNIKVVYVRNHVTAAIKYIDDTAGDDLSAYNKSITAKPGEALNYTTKDSITELQNKGYVLVSDNFNVTTMPENGGNYEVHVKHGTKTIDPDNPTDKYTKKDLQKTATRTINYVDDQGNKIAESVTSTVVFTGTGTVDAVTGNLVNLHPDGSIKDQNGKLTWTYSVDGGVVQKSDTYTFSATTARPTIDHNNSTYNFTSTTPADYNAGNGAVSSYRVNSTDPQNLIVNVVYTKQAIYHAGKTETKSVTRTINYLDGKTGEKIPTDLIATNPVAQTVNLHRTEIIDDNGKVIGYGTISKDGKSYTINNDWVVDGKWASVTSPDLSAKGYKAPRFENGTSAARVDEVIVGSGTKDATVNVYYDHNLIPIGPDNFDKHGVDRSQIEKQVKETVHYVGAGDKTPADHVQTSKWTRTITIDAVTKEVVPNGQYTTDWTIPKGEKTEYAQVNTPVVNGYYADQANVPATTVTQNDIEKTVTYKQIGRIVPVDPNGKPIPDAPTPQYPNDPTDPTKVLPNVPVPNIPGYKPSVPTVTPTDPGKDTQVPYTPVTPTNPDNPVIPTPQPEPNPDNGKDKPVDPSKPSDDPVHPEYPGIKRGQDKPDKEKTDKKRNGKTKGKENTPTGRDAVKRAGRSDDALKLASEAKNRRMTIQGKNEELPQAGEDHNAMALIGLAFATLAGSVVFATDRKRR

SEQ ID NO: 21 - DNA, 3522 bp, Lactobacillus acidophilus
  misc_feature (0)...(0): ORF 1652 -  mucus binding protein precursor; Mub
  CDS (1)...(3522)
atggtacatgaaaaaaagaagatgagaaaaaatcataagaagataacccacaagggtaaaaagataaccacgggggccgcttccgtattacttggagctggaattgtggtaggagcaaatgctcgtcctgtcaaagctacaagctcacgcgaagatgaaattactgaggtagatactattaatgtgattagtagtgaaactgaaaaagcagatgtagagcaaagaacagatactactgaaactgtagaaacagaaggtaatgtggataatacaaatacggaagtttctgtacctatagatgaaacaattaatactgaagctcaagctgcaaacaatacaacacaggttgaatcaactgtagaagatacaacacaagaagagactacagaaacgcaacaaaatccttcagtggataatcaagagccggttttaagtgatcctcctagtgtggaatcaccagaagattcagctacagaagttacaactactaagacaactgatgaagtaaaaaatgcagctgatgaagccaataaagaaaacaaagataagttagatgcggaaataaataaggctgaggataatggtcatacagtaactcaagatggtgacaaagtatataaggctgatgcaactaatatcgataagataattgaagatcttaatcaatttactgctgatcaaattactgatattgaaactaaattagctaaatataaagaagaactagaagcgtacaaggctgatcaagtaagatacgaagctgaattgaagaattatcaaacagctaaggatgcttatgttaaaaaattagaagaatggggtctttataagccaggcgatattgatccaagtgatatttcacagagtttaattttaggagaagagaaaaactctaaagttgaagttctaaataagggaagtgtcgtagatgaaggaaccggcagtatcttaaatggcttattgaatcatttctacaccattgatgaaaaattcgacggcgagttcttgaagctgcaatatactaacttagagaacataacttatatgggtaagaatatcgatagtattcagattatctttagtggttggaatcctaactataaggggaaaaatgctgataagagaacttcaggtatttatttcagtgacaaattaactgacggttttttctacgtaaacagcgatggcgtaaccatggaaatgattttgtttgaaaatggtaaaaccattaacctagataaaaattccgcatatattactgctggttccttgaacagtcagggtacaggtaatgactatattgaaaaagctgaaatatttaacaatagtagcgaatatggcggtagtgctgttacattccaggattcattcataagacgtcatgatggtacttatggtggggatgttctatatgcggaccaaaatatcgaagttttagccgtatatccaggtaaagatcaaactttagaagatgcaattgaagagcagaagaaattagctcttgaggctggatggaagcaagaaattatcgataagttcattaactgggatagctctaccgatcgctcaaaggcaatctttggcgcaggtgcatttatggtctatggtaataagatcaagattagatttagtaacggcatcggttcagcttgggcaacatattctacttcaatcccaggtatggcattccgtgaagaaaagccaaaggaacctactgtacctgagccacctaagttagatcttacttacacgccaggtcatattgaattatccaaatctaacgtccatattcactatgttgatgttcatgatactgcacaggctggtaaaaatgatagctttgttcctgatgatggtatagagcttgatgatcatgttgatcatcaattagatttattaatcggtaccggttataaccacgacttatggaatttcgaagatgccggatatattttggcagaagaaatcaaagatggtgtgcaaaatggtacggttattaaagacgatcaacaccattatgtttacttgaagcataaatttattccgacaacggatgaagagaatgaaaagaaagatgtaaatcaagtcattcattatgtatatgatgcaactggtgaaacggcttataaggactatcacgcagttacgcttcacttcattaagagtggacaaaaagatgttgtgaacggcaatattatttggggcaattggacacttgcacaagactttgcaggtgtgaagagtccgtcaattgaaggttatcatctcaaggataaaaatgacgatgtagttggtccatacacgattgaagtaacggagaaaaattaccaaaataatcttgatgtagaatacacggtaagatacgtagctaatgctactcaagagcttaacctcaagaaagaagttaaccaagtcatccattacatttacgaaaatggtacgaaagctcatgatgattatcatgcattgactctactctttgagaaaaaaggtatcaaagacttagaaactggagaagaaacttggggtgaatggactaagacacagacattcgtagtggtaaagagtcctgatattcaaaattacattgcggatagactagaagttggtccatatgaaatcactgtgactgatgaaaattacaagactaacttagataaagacgacattgtaatctacagagctagaatcgaagaagttacacgtgataaggtagttaaccaagtcattcactatatttacgaagatggtagtacagctagaccagaccatgtgagtgtaaaacttgtcttcacccaaacaggagtaaagaacttggctactaatactacgaattggaatggtgaatggactaagacacagacctttgtcgtagtgaagagtccggagattgaaggctacactgcagatcgcgaagaagtaggcccatatgatattactgtaacgaatgaaaactacaacgataaattagataaagaggatactgtaatttatagagcaaatactaatgttccggataacccagatccagataatccaactccggataatccagatccagataatccaactccagacactccaacccctgatccaactccaggcgatgatgaagaaattgccacgccacctcttccagaggatgaaattggtaattacccatctcaatcagacgaagatgatgaagaagagcgcacagctccacatgctacaggaaaagaaacaagatcaggaaccaacaaaaacaatgctagagtaatttctcttgaaaatgcaggaagtgatgattcagtaactccagaaaatgtttcaactgaagcaacggataaaactgatgaaaaacaaactactgttaactcaacaaatgaaaagactttaccagcaactggtgaagaaaaagatgattttgctaaagtgatgagtgggttagcagctgcattaggaattacaggattagctgtaacttctaagagacgcaaagctactgcaaaacgcagcaagaaagataaaaagaacggtaaa

SEQ ID NO: 22 - protein, 1174 aa, Lactobacillus acidophilus
MVHEKKKMRKNHKKITHKGKKITTGAASVLLGAGIVVGANARPVKATSSREDEITEVDTINVISSETEKADVEQRTDTTETVETEGNVDNTNTEVSVPIDETINTEAQAANNTTQVESTVEDTTQEETTETQQNPSVDNQEPVLSDPPSVESPEDSATEVTTTKTTDEVKNAADEANKENKDKLDAEINKAEDNGHTVTQDGDKVYKADATNIDKIIEDLNQFTADQITDIETKLAKYKEELEAYKADQVRYEAELKNYQTAKDAYVKKLEEWGLYKPGDIDPSDISQSLILGEEKNSKVEVLNKGSVVDEGTGSILNGLLNHFYTIDEKFDGEFLKLQYTNLENITYMGKNIDSIQIIFSGWNPNYKGKNADKRTSGIYFSDKLTDGFFYVNSDGVTMEMILFENGKTINLDKNSAYITAGSLNSQGTGNDYIEKAEIFNNSSEYGGSAVTFQDSFIRRHDGTYGGDVLYADQNIEVLAVYPGKDQTLEDAIEEQKKLALEAGWKQEIIDKFINWDSSTDRSKAIFGAGAFMVYGNKIKIRFSNGIGSAWATYSTSIPGMAFREEKPKEPTVPEPPKLDLTYTPGHIELSKSNVHIHYVDVHDTAQAGKNDSFVPDDGIELDDHVDHQLDLLIGTGYNHDLWNFEDAGYILAEEIKDGVQNGTVIKDDQHHYVYLKHKFIPTTDEENEKKDVNQVIHYVYDATGETAYKDYHAVTLHFIKSGQKDVVNGNIIWGNWTLAQDFAGVKSPSIEGYHLKDKNDDVVGPYTIEVTEKNYQNNLDVEYTVRYVANATQELNLKKEVNQVIHYIYENGTKAHDDYHALTLLFEKKGIKDLETGEETWGEWTKTQTFVVVKSPDIQNYIADRLEVGPYEITVTDENYKTNLDKDDIVIYRARIEEVTRDKVVNQVIHYIYEDGSTARPDHVSVKLVFTQTGVKNLATNTTNWNGEWTKTQTFVVVKSPEIEGYTADREEVGPYDITVTNENYNDKLDKEDTVIYRANTNVPDNPDPDNPTPDNPDPDNPTPDTPTPDPTPGDDEEIATPPLPEDEIGNYPSQSDEDDEEERTAPHATGKETRSGTNKNNARVISLENAGSDDSVTPENVSTEATDKTDEKQTTVNSTNEKTLPATGEEKDDFAKVMSGLAAALGITGLAVTSKRRKATAKRSKKDKKNGK

SEQ ID NO: 23 - DNA, 2091 bp, Lactobacillus acidophilus
  misc_feature (0)...(0): ORF 1218 - mucus binding protein precursor
  CDS (1)...(2091)
atgtataatgctgctaatcaacaagtttcctataatgattttgtaaatgccagcaaacaaaatcagccaattcctgtagtaaatacaattaaattcaatgaaaatggtaaatttggcgatggctcaaatgactggagtaaaaatggcgggactaacggagaaaacaacaataataccgttatacataatccacatagtacatttttgattcaaatggatacacttcttccaaccaatattcctacaaattggactaaaccaggcaacggtccatcttctactattactatcccaaataatcctcatgcagtagttacttctgattccacaactggtaatacatcaacttatattggcttcaataatggtggtagcggatttataaacaatacaaaatttactgctgatttatattttgctgatgtcactaaacatgagagtataaaagatttaggtggacaaaataatattcctttaacagttaagggtgtaaatgaagagagtgcaacgctaagcacactaataagatttaataatattgagagctttattaagaatttaaataagagtggatacgcttttgttggtgcttctactggaaagcacgtttctggtaagtatactaattcaactttatattcttctaaaaattatgaagataataaatatggtaattatgattgggaaggtaaggaatttacactaaattttgtaaaattaagttctcaaaataagagtgttagcgattcagttaaatatatttatgaaaatggacctaagaagggacaagaagttgaatctgaatatgctaaacctagttctcaatctttgacgtttaatcaaactcagatagtggacgataacggcaatgtcgtatatccttcaacatggcttgctgaaaataataatggtaaattcgatgtaatcaatattccaactaatgttaatggtaatacgaaatatagtattgattatgataatatcactttgaataatgaaaagttgtcggcattagacaaaagtgtaagtgttgaccgaaagaaaaatataatcactattacaattgataaagacacaattccagaaaaaacacgttttgatttagttattccatataaattaattgaaaatattcgtgttcattatattgatgaagatataaaaggtggtagtgaaattaaccatgctttaaatattaaagtagacgattctaaattgcatactttttatagtggtgatcctgaaactacaactgccaatttgactcatgatactattaactatcttgaaacgctaaattatattttagatattgatgctacaaatggtggaaaagcttatacatctatacctaattatgattcaagtaagttgaactttaatgatcaagttaacaagtataccagtgataagttgacatttgatgatgacgaaaatcctaatgattattatgtttacttgtatcacaagataaaggaagataagatacgtgttcaacagaaacaaattgaagaagtgattcattatgttgatgaagatgatgcttatgataaacaagggaatttaaaagatttagctacgccgtatatttctgatactttaacatttagtagggatgcaaatgtagatcaagtgactggtaaaacagtcagttggaataattggtcaattggaacttttgattcacataagaatgcaagtatttccaattatacaattgaccttgagtcaaagatttttagtcaaaaactaaatggtaaagctacacatttggctgacattacttcagatcaagttagtgcaataaatgcatttgcaaataaagatgcccaaaaagaaattgatgctttgcctaaaggtaagtcacttattgaaatagtaattccatataagcataatgctcaaaagcctgaacctccaaaaaatccaggagatacaccatcaactcctacgaatgtacctgatactccgccagcaccaagtaatccagtaattccttcaacgtcaactccttctgataatccaataactcctaatattccatctgtttctaattctaagaaaacaaataataagacaactgatctaagt

SEQ ID NO: 24 - protein, 697 aa, Lactobacillus acidophilus
MYNAANQQVSYNDFVNASKQNQPIPVVNTIKFNENGKFGDGSNDWSKNGGTNGENNNNTVIHNPHSTFLIQMDTLLPTNIPTNWTKPGNGPSSTITIPNNPHAVVTSDSTTGNTSTYIGFNNGGSGFINNTKFTADLYFADVTKHESIKDLGGQNNIPLTVKGVNEESATLSTLIRFNNIESFIKNLNKSGYAFVGASTGKHVSGKYTNSTLYSSKNYEDNKYGNYDWEGKEFTLNFVKLSSQNKSVSDSVKYIYENGPKKGQEVESEYAKPSSQSLTFNQTQIVDDNGNVVYPSTWLAENNNGKFDVINIPTNVNGNTKYSIDYDNITLNNEKLSALDKSVSVDRKKNIITITIDKDTIPEKTRFDLVIPYKLIENIRVHYIDEDIKGGSEINHALNIKVDDSKLHTFYSGDPETTTANLTHDTINYLETLNYILDIDATNGGKAYTSIPNYDSSKLNFNDQVNKYTSDKLTFDDDENPNDYYVYLYHKIKEDKIRVQQKQIEEVIHYVDEDDAYDKQGNLKDLATPYISDTLTFSRDANVDQVTGKTVSWNNWSIGTFDSHKNASISNYTIDLESKIFSQKLNGKATHLADITSDQVSAINAFANKDAQKEIDALPKGKSLIEIVIPYKHNAQKPEPPKNPGDTPSTPTNVPDTPPAPSNPVIPSTSTPSDNPITPNIPSVSNSKKTNNKTTDLS

SEQ ID NO: 25 - DNA, 6957 bp, Lactobacillus acidophilus
  misc_feature (0)...(0): ORF 1020 - Mucus binding protein
  CDS (1)...(6957)
atgtatagaaatagggggacacgagacatggtttctaagaataaccgcgataagaagatggaagcggtagccgaacgtaagccacactttgctattagaaagttgactataggtgcagcttcagttcttctaggtacaagtttatggatgagtacttctactagtacggttcatgctgatgaaactgacaataatgacagtgatgctaagacaaatttagaaagtaatcagtctgcttcaactggtcatgttgaaaaggttgttgttgaacaaaatcaaacagcaaatgaaaatacagatgatagtactaaaactaacaatgtatccgcacaaaatactcaagaaagtgttgatgagtcaagtgatatatcttcagataatgcacaacaaaataaagctataacttctgaagaacaaaattctgatgctgcagtaactattgataataatcaagcagcagatgagaataaggctgagactcaaaaggtaactgataagactactaaaactaagcaagatgataataagagtagtcaaactattgataataaaaagtcgtcagaaaaagctgctacagatactagtaataaaaacaatgtagaacaaagtgctaattctgtagaaaataatgctaatatagacaattccattgcggcaaacactcaaacagatataactaaatcaaatatacaacttaatgaaagtttgccttcaatagctcaagctggtcaaaacggtaagactattgttaaagataatgatacaactactcaagaattaaagattggtgatctttcatcagacttgagtggagatgccttaaaagctaatttaactaagggaaatcaagtattattaaaccaatctaattctagtgaagttgtagtaggtaaaaatgtagatcctactaagcaattgcaagcaatggcaagaactgctatgtttgctgcagtaaatcctaatgcagctgataactacactactgttagtgactttaatgctcttcaacaagctgttaatgattacagtgtcagtggtgtaaatatcagtggtaacattactgcatatggcgatttaaacattaatcgtacatttactattaagggtgctgacaataatgctacattaagtcttggtcaaaacaagattaataataatggtcaattaactcttgatgacattactgttaatggttcaatccttggtaatggtactgtaaatattaagggtactgttacttcaaatgtaaatagtgttaactcatctgttccaacacaggatcaatttaaagctcaaaattatactggtaatagaaataactttaagaattctaacattgctggtaatagtgtaaatattgaaaacggtgcatcattaactattaatagttctgaaattaatgatggtattaatttaactgacggtgggacagttcgtgttggcgataacgctaccttaaatgttaatttaactaacgcttcaactactgctactcgttaccatgtagccggtgtatttgcaaaaaatggcggtaactttattagtggttacaagtcaaacgtcaactttaatactggtttaggacaagctattgctattggcgctactcgaccaactggtactgattcagatcgatttggtggatatggtgcacgttcaagaaatgatggaccaacattagttcaactaggtgattcatcgacatttaatttcactggtcgtgacggtattatcttaggtaataacgccaactttatttctggtgaaaattcaaatgttcattttgaaaataagggtcgtggggttgccttagatttagctgctaactcaaatatcgaaatttctaagcactctactacatatttccattctgtcggtaagactggaacgtcaggtagttatgatggttacaactacattggtgttaacgaaggcggtaatattactgttgatgagtacgctacattccgtgtaattcttgaaggtcgtggcgataacccatgggacgatgttgtttcacttgattcacaaaatgcgaatactactgctgcctttacttcaaagaaaggtgcgattgtcgatattcgtgatgataataccaacttctatgctgaattaatttccttcccattaggtggatctaattcacgcattgatatccaagatccattgatgcttaacttgcaacgttattctaaaggcggagcaactactggttggatgccaaccggtggtgacatgattaacaccacttcagcagaatatacttccaatttgatttatatgtctggtaacaaaggagtatttagtgttagtggtggcgactatgatccatcaaatcctaatagttcagggtttgttgtttaccaacgtattaagtcagatggttcaaagcaaatttggcttaatgtaaatgatgtaaatattccaatgaatggattccagactaaggatatttggaataatcaggcaaacccagatgtatcaattacgggtaatggcttaactggtggtattagagctaaccaagttcataactataatggttctccattaacaggtaaagatgcaccatattatggtatttctactcagcgtgcgagccaacaaatttggattcctcatagaacaccgttggaaataactggtaatcatacaaatactattaagtatgttgatgaacaagggaatgaaattttcccagaaaatacctcatccttaaatttgaagcgtaatattatccttgatattacacaagaccaaattaagaaaattcaagattatgcattgaaccatacagctgatgaaacattagagtatataaagaatagccaatcagttgctcaagattcaggatggaaatttactaacggtagcggtcagacagtgacagatccatatgctaccgtagaatcacctaaactggatggctatactgctactattcaatcaactaatgttcaaggtttaaaggttggagaagacgcctcttctgtaactgctaaatttgcagtaaatccatccgaagatatagttcaaaatggtgaattgacagatagctataagaatgacggtattactggcatacctgataattatgttactgttgttgtctacaaaaaagcagttgaaaaaggttcagtaaaagttgtttaccacgatgatactactaacactgagattccaaatactgaatacaatactggttcagtagacgctggtactaaagtggactacacaactacaactactatcaccaatcttgaaaatcaaggatatgtatatgtatcaacagatggtactataccttcaacaattgaaggaaatcaaaacgtagtagtaactgtacatatgaagcatggtgtgcaaccagtaactccagatacaccaactccagatgtaccaaagaatactccagcagaagcacaacctgatcaattaactaaaaaggttaacttaactgttaactacgtaaatagcgatggttcaacctttactgctactgttcctgcaaatgctaagcaaactgttaccttcactggaactgcttatgtagataaagttactggtcaattggttaacgctactcaacaaaatggtcagtgggtaatcgatgagaataatactgcaactccacaaatcacgtggactagcgataagacctcatttgataaggttgtttctccagtagaacaaaattaccatttaatcagtatttctgatcatcaagatggcaacgatgttgccacaattactggtctgactaaagatagtggagatattaccgtaactgtaacttatgctcctaatggtaagatcatcccagttgatccatcagggaacccaattccagatgcaccaacaccacaatatccaacagatccaacggatccatctaaagtaactccaaacgaaccagtaccaaatgttccaggttacactccaagtgttccaacagtaacaccaatagatcctggtaaggataccccagttccatacactcctgaaacgccagctaaggatcaaaaggctgtagtaaactacgttgacgctgatgaagataataagttaatcactagttcaggtgacctaacaggtaaggctggtacaaagattgactactcaactaattcaactattgaagacctcactaacaaaggatatgtattggtaaacgatggcttccctaaggatgctacatacgacaatgacgacaatactactcaaacttatacagtggtattacgtcatggtactcaaccagtaaatccaactaacccaggtaagccgggcgaaccaatcaatcctaatgatccagatggtcctaagtacccaacgggttctaatgaagtaactaagacagttactagaactattcaatacttagacgaagatggtaataaagttagtgattctgttgagcaaccagtcaactttactgaaagtggtgttcttgacaaggtaacaggtgaatggacaactccattaacttggagtgttgatcaaactgtctcagcagttaaatctccagttgtttctggatatcacttggtaagtgttgatcgtgatcaagatggtaataatgtaaaggatgtaactcttactcatgatgataatagttacatagtgactgtgcgttatgctaagaacggtaagattattccagtagatccaaatggccacccaattccaaatgtaccacagccacaatatccaaccgatccaaataatccagctaaggtaacaccggatgagccagtgccaaatattcctggtatgactccaagtgttccaacagtgacaccgactgatccaggtaaagatactccagttccgtatactccagtagcaccagctaaggatcaagttgctcaagtaatttaccgtgatgtaaatgatccaaacaaggtaactcaacttgcaacttcaggtgatcttactggtaaagctggttccgagatcgattacaatgcacaatctgaaatcgataacttgattaataagggttatgtgcttaagaacaatggcttcccagcaggtgctgtgtttgataatgatgacaataagacacagaccttctatattgactttgttcatggtactgttccagtaacgccaactgatccaggtaagccaggtgaaccaattaaccctaatgatccagatggacctaagtggccagatggtactagtgaagatagtttgaagaaatcaggtacacaaacaattcactacgtatactcagatggaagcaaggctaaggatgacaatgtacaaagctttgattttactaagagtgcagtagttgataaagtaaccggtgaaatcattagtcaaactggttggaatgtagatagtcatacatttggcaatgtagatactccagtaattgatggctaccatgcagacaagcgtactgcaggtggtaccacaattactccagatgatttgaacaaggaagtaactgtaacttacacaccaaacggtaagattattccagtagatccaaatggtaacccaattccaaatgtaccaacaccacagtatccaaccgatccaactgatccgactaaggtaacaccagatgaaccggtaccaaatatccctggtttgactccaagtgttccaacagtaactccaaccgatccaggtaaggatacaccggttccatacaacccagtagttccagctaaggatcaggcagctgtagtaaactacgttgatgctgatgaagataataagttaatcactagttcaggtgacttaacaggcaaggctggcgaaactattaactatagtactgccgatacaattaaagatcttgaaaacaagggatatgtattggtaaatgatggcttcccagcaggtgcaaaatatgacagtgatgacaacactactcagatttacaccgttgtcttgaagcatggtacaactactattactccagataagccaggtaagccgggtgaaccaattaatcctaacgatccagatggacctaagtggccagacaatagtggtgaaaacaatttatctaagactggtacacaaactattcactacactggcgcaggtgacaagactcctgaagacaacaaacaagagttcactttcactaagacaatggtagtggataacgtaactggcaaggtaattactgatggtgcttggaatgtaactagtcatacatttggtaatgttgatactccagtaattgatggttaccatgcagacaagcgtactgcaggtggtaccacaattactccagatgacttgaataagactgtaactgtaaactacacaccaaacggaaagattattccagtagatccaaatggtaacccaattccaaatgtaccaacaccacaatatccaactgatccaactgatccaactaaggtaacaccagatgaaccagtaccgactattccaggttacactccatcgaccccaacagtaacaccaaccgatccaggtaaggatacaccggttccatataacccagtagttccagctaaggatcaaaaggctgtagtaaactacgttgatgctgatgaagataataagttaatcactagttcaggtgacctaacaggtaaggccggcaaaaagattgactactcaaccagttcaactatcgaagatcttattaacaagggatatgtattagtaaacgatggtttccctaaggatgctacgtacgacaatgacgacaatactactcaaacttatacagtagtattcaaacacggcactgttccagtaacaccaaccaatccaggtaagccaggtgaaccaatcaatcctaatgatccagatggacctaagtggccagatggcacaggtgaaaacagtattgataagactgtaactcgtaccattactttcgtagatagcaatggtaaggaagtttcaagtcctgtagaacaaagtgttcactttactgcagtgaaagat

SEQ ID NO: 26 - protein, 2319 aa, Lactobacillus acidophilus
MYRNRGTRDMVSKNNRDKKMEAVAERKPHFAIRKLTIGAASVLLGTSLWMSTSTSTVHADETDNNDSDAKTNLESNQSASTGHVEKVVVEQNQTANENTDDSTKTNNVSAQNTQESVDESSDISSDNAQQNKAITSEEQNSDAAVTIDNNQAADENKAETQKVTDKTTKTKQDDNKSSQTIDNKKSSEKAATDTSNKNNVEQSANSVENNANIDNSIAANTQTDITKSNIQLNESLPSIAQAGQNGKTIVKDNDTTTQELKIGDLSSDLSGDALKANLTKGNQVLLNQSNSSEVVVGKNVDPTKQLQAMARTAMFAAVNPNAADNYTTVSDFNALQQAVNDYSVSGVNISGNITAYGDLNINRTFTIKGADNNATLSLGQNKINNNGQLTLDDITVNGSILGNGTVNIKGTVTSNVNSVNSSVPTQDQFKAQNYTGNRNNFKNSNIAGNSVNIENGASLTINSSEINDGINLTDGGTVRVGDNATLNVNLTNASTTATRYHVAGVFAKNGGNFISGYKSNVNFNTGLGQAIAIGATRPTGTDSDRFGGYGARSRNDGPTLVQLGDSSTFNFTGRDGIILGNNANFISGENSNVHFENKGRGVALDLAANSNIEISKHSTTYFHSVGKTGTSGSYDGYNYIGVNEGGNITVDEYATFRVILEGRGDNPWDDVVSLDSQNANTTAAFTSKKGAIVDIRDDNTNFYAELISFPLGGSNSRIDIQDPLMLNLQRYSKGGATTGWMPTGGDMINTTSAEYTSNLIYMSGNKGVFSVSGGDYDPSNPNSSGFVVYQRIKSDGSKQIWLNVNDVNIPMNGFQTKDIWNNQANPDVSITGNGLTGGIRANQVHNYNGSPLTGKDAPYYGISTQRASQQIWIPHRTPLEITGNHTNTIKYVDEQGNEIFPENTSSLNLKRNIILDITQDQIKKIQDYALNHTADETLEYIKNSQSVAQDSGWKFTNGSGQTVTDPYATVESPKLDGYTATIQSTNVQGLKVGEDASSVTAKFAVNPSEDIVQNGELTDSYKNDGITGIPDNYVTVVVYKKAVEKGSVKVVYHDDTTNTEIPNTEYNTGSVDAGTKVDYTTTTTITNLENQGYVYVSTDGTIPSTIEGNQNVVVTVHMKHGVQPVTPDTPTPDVPKNTPAEAQPDQLTKKVNLTVNYVNSDGSTFTATVPANAKQTVTFTGTAYVDKVTGQLVNATQQNGQWVIDENNTATPQITWTSDKTSFDKVVSPVEQNYHLISISDHQDGNDVATITGLTKDSGDITVTVTYAPNGKIIPVDPSGNPIPDAPTPQYPTDPTDPSKVTPNEPVPNVPGYTPSVPTVTPIDPGKDTPVPYTPETPAKDQKAVVNYVDADEDNKLITSSGDLTGKAGTKIDYSTNSTIEDLTNKGYVLVNDGFPKDATYDNDDNTTQTYTVVLRHGTQPVNPTNPGKPGEPINPNDPDGPKYPTGSNEVTKTVTRTIQYLDEDGNKVSDSVEQPVNFTESGVLDKVTGEWTTPLTWSVDQTVSAVKSPVVSGYHLVSVDRDQDGNNVKDVTLTHDDNSYIVTVRYAKNGKIIPVDPNGHPIPNVPQPQYPTDPNNPAKVTPDEPVPNIPGMTPSVPTVTPTDPGKDTPVPYTPVAPAKDQVAQVIYRDVNDPNKVTQLATSGDLTGKAGSEIDYNAQSEIDNLINKGYVLKNNGFPAGAVFDNDDNKTQTFYIDFVHGTVPVTPTDPGKPGEPINPNDPDGPKWPDGTSEDSLKKSGTQTIHYVYSDGSKAKDDNVQSFDFTKSAVVDKVTGEIISQTGWNVDSHTFGNVDTPVIDGYHADKRTAGGTTITPDDLNKEVTVTYTPNGKIIPVDPNGNPIPNVPTPQYPTDPTDPTKVTPDEPVPNIPGLTPSVPTVTPTDPGKDTPVPYNPVVPAKDQAAVVNYVDADEDNKLITSSGDLTGKAGETINYSTADTIKDLENKGYVLVNDGFPAGAKYDSDDNTTQIYTVVLKHGTTTITPDKPGKPGEPINPNDPDGPKWPDNSGENNLSKTGTQTIHYTGAGDKTPEDNKQEFTFTKTMVVDNVTGKVITDGAWNVTSHTFGNVDTPVIDGYHADKRTAGGTTITPDDLNKTVTVNYTPNGKIIPVDPNGNPIPNVPTPQYPTDPTDPTKVTPDEPVPTIPGYTPSTPTVTPTDPGKDTPVPYNPVVPAKDQKAVVNYVDADEDNKLITSSGDLTGKAGKKIDYSTSSTIEDLINKGYVLVNDGFPKDATYDNDDNTTQTYTVVFKHGTVPVTPTNPGKPGEPINPNDPDGPKWPDGTGENSIDKTVTRTITFVDSNGKEVSSPVEQSVHFTAVKD

SEQ ID NO: 27 - DNA, 7950 bp, Lactobacillus acidophilus
  misc_feature (0)...(0): ORF 1019 - mucus binding protein
  CDS (1)...(7950)
atgatttctaaaaataatcgcattaagagaatggaagcaacttcagagcgcaaacagcatcatgggattcgtacactatctgttggtgccgtttcagttcttttaggaactactttgtggattagtattcctactagcacagttcatgctgatgaaattaatattgatgacaatcaacctaaaacaaatttagaaagtaatgaatccgcttcaactgatcatgtagaaaaagtgattgttgaacaaaatcaatcatcaagtgaaggtgctcaacaagatattaatgcagcaaatgatgtatctgcacaaaatgatcaaaaaagtgttaataaaataaatgatgaaattataaaaaatgaaaatgtagacgctgatattaaaacaaacactgataacagtcatgctgaaacatcttatggtcaaactgaatcacaagaaataattgaaaataaacaaaaaacagatgttgaaaaaaataaaactcaaacaacagataatattacaccagttgagcaaactggcaattcatcagaaaatacatctacgaatgtaaccactcaaagccctgtagataatagtactaataatgatgttaatgtaaataattctaatttagctgatacacaagcagaattaattgattcaaatacacagttttatgaaagttcgcctttaattgatcaaattggtcagcaaggaaaaactacggttaattctagtaacaatactagttctaaattaaatattgatgatctttcaccagatttaagcgatgaagtattaaaggctaatttaactcaaggtaatcaaatattgctaaatcaatctaattctagcgatacaatggcaggtaaaaatgctgatcctactaaacaattagaggcaatggctaggacagctacccttgttgcagcgagtccaaatgcagataattacactactgttaataactataatgatcttcaaagagctgttagcaattatagtgtaagcggagtaaatatcgatggtgatatttatgtttttggtaatttaactattaatcgtgcttttactattaagggaactaataatgcaaagttaaatttaaatcaaaatgcaattattaataattctactttaactcttgaggatattactgttaatggttcaattatgggtaatggaacagtaaatattaaaggggatgttatttctaatgttaatgaatctaatggttatacgcttaccaattctgaaaaagcaactcctggtgttaaggtgaattggactcaaactaaaggatataacattcaatcaagtactgttaatgtcgatgataatgcttcactaacaattaatcgctcatctgttggcgatggtatccatttgttaagtaatggtattgttaatgttggtaattatagccaattaactattaatatgaatactaataatgaattgggcacaggagctactgctcgttaccatgatgcaggtatttttgctgaaagtaatggtagttttactacaggatataagtctgtagtgactctaaacaccagtattggtcaaggaattgcgatgacaggtctgagacctaacgtaacagataatgatcgttttggtggatatactcgtgatcgcgcgaatggtgcgggtcaaattaatttgggtcaatactctactttaaactttaccggtcgtgatggagttattttgggtaataattctaattttaacgttggtgaatatgccaatgtccactttgaaaataaaggacgtggtgttgctcttgatctagcaaataatagtaatattaatattgctgatcatgcagtaacgtatttccattcagtaggtaagaataccactaatgctattggtgttgtagttggtccatcaggtagttatgagggttataactatattggtgtaaatgaagcaggaaatattactattggtgaagatgcaacttttagagtaatcatggaaaatcgtggcgacaatgcttgggatgatgttatttctttagattcacagttggcaacaacaaatgctgcctttacttccaaaaaaggtgctattattgacattcgtgatgataacactaacttctatgcagaattgatttccttcccattaggagctgcaaattcacggattgatattcaagatccgctgcttcttaacctacaacgttattcagctggtggtgagactactggctggatggctggagttggtggggtagctattaattctacttctgaaaaatatactgctaacttgatttatatgggtggtactaaaggtgttttaagtattggtggtactaactatgttgtttaccaacagattaaatcagatggtgcccaacaaatttggactgatgtagatagtgtagaattccataaaaatggttttgcttcacaagatattttcaataatggagctaattctgatgtttcaattagcggtaatggtttcacaagtggaattcgtgctaaccaaatccgtgacaatcagactgatccgactttagtgaacttacaaaatagtcctgcttacggtatttcaactatgcgtgcaagtcatcaaatttggattccacatgaaacttctactcagattaagggaacacatactaatactattagttatgtatatgaagatggaacaccagttatgggtgccgatagtcaaccattagttgtgactcaaaacttgaatttagcacgtgatttaactcttgatctaacttctgaacaaattaaaacaattcaagactatgccttaggacatactgctgatgagaccttgaattatattagaagtggctactcagtaactcaagattctggttggacgtacactaatgatcaaggacaaaaagtgactgatccatatgcatctgtgacttccccagtaaaagaaggatatattattactattcaatcaactaatgcaccgggtgtaactttaggtgctgatggtcaaactgtaaaagctaattttgtgtttgatgcagccaatgatgtggtgcaaaatggtcaattgtcagctgggtatagaaatcaaggtattactggtattccggacaattatcaaacgatcgttgtttacaagaaagcagaaaagggttctgttcaagtaatcttttacgatgatacgactaacgatgctatcccaagtgttggttttaattcagggacagaggaagcaggaacaccagttacatatacaactgcacaaaatattagtgatttagaaaaacaaggatatgtatatgtaagtacagatggtgtgattccaacaactatacctaataatgcaaccctaattactgttcatatgaagcatggtaccaatccagtcaaccctgatcagccaactgataagtatactaaggaagatttgcaaaagacagtaactcggacaatcaattatattgacactgctggcaatataattgctgactctgttacttcgacggttgtctttacaggttcaggcacaattgatacagtgacaggtaacttagtaaccgttgatgcaagtggtaatattgtagatcaaaacggtcaactcacttggacttattcagtagatggcgatagtgctcaaagtggtaattcttatacatttgctgaaactgctgccaaaccatcaattgattataatggatctacatataactttgtttcagtaactcctggtaactatagtgccggtaatggtagtgtgacgagttatgaagtaaacactaataattcacatgacttaacagttgatgttatttacaatgagggagcaacttatcatacaggcaagactgatactaaaaatgtaactagaataattaattatttagatggtaaaacagatgaaaaaatcccaatcaacttgatcctagctaatccagttgaacaaactgtaagtatgtatcgaactgaaattttggattcaactggcaaggtgattggctatggtacagtgagccaagatggtaagatgtacactcttaataataattggattattgatggaatttgggaaagtgtgaattcacctgatttaactacaaatggatataaggcaccacggttcgaagatagtagtttagctgcaattgtagctgaatatattgttaatgctgatactaaaaatgcaacggtaaatgtatactatgatcaccaagtgattccaattggaccggatactccagacaaacatggtgtagatataaatcaagttgaaaaggttgttaaagaaacggttcattatgttggcgcgggtgataagactcctgctgatcaagttcaaacttctaaatggattcgtactgttactgtggatgtcgtgactaatgaagttgttccagatggagaatttactactgattggacaattccaagtgatgaaaaaagcacttacgatcaagtagatactccagtagtgaatggctactatgctgatcaagctaatgttccggcaactgctgtaactcaaaatgatattgaaaagactattacttataaacaaattggtaaagtaataccagttgatccatcagggaatcagattccgggtattgatactccacatttccctaacgatccaaatgatccaactaaggtaattccaggagaaaagccatatgtaccaggatatcatcctgaaactggaaaaccaggtgacgcagttgatccagctccaggtgatccgagtaaagatgttgaagttccatatactccggaaactccaattgtagatcaaaaagcagtagtaaattatattgattctgatgaagaaaacaaagtgatcacttcttcaggtgatttaattggaaaaccaggtgagcagattgattatacaactataccaacaattacagatcttactaataaaggatatgtgttgatttatgatggctttccaactagagtaacttttgatgatgatgatggtattactcaaatattcacggtggtattaaaacatggtacacaaactgtaaccccagaaaaaccaggaataccaggcgatcccattaatccgaatgatccagatggacctaagtggtcagatgaaactggaaaagatagcttgattaagactggtactcaaacaattcattatgaaggagcaggtagtaaaactccaacagataacgtgcaaaacttcgagtttactagaaccgctgtgattgacaaagtaactggtgaagtaattagcactagtggttggaatgtaactagttatacatttggtaatgttgatactccaatagttgagggctatcatgcagataaacggaatgctggtggtacaacgattacaccagatgatttgaacaagatgctggtagtaagatacacaccaaatggtaaaattattccagttgatccagctggcaatccaattccgaatgtaccaacgccgcagtacccaacagatccaacagatccaacgaaggtagtgccggatgaaccagtgccagctattcctggctatagaccaagcacgccaatagttacaccaacagatcctgataaagatactccggttccatatgctccaattcaaggttcaatacaagtaattttccacgatgacaccagtaatcaaactattccagatgttggttataactctggagtacaagatgaaggtactaggatcgattacacgactaacaaaaatattaccgacttgattaataaggggtatgtatatgtaggaacagatggtaatgtcccagcagaaattgttgctgatcaaaatattactataacagtccacatgaagcatggaacaaccacgattactcctgatcagcctggtaagccaggtgaaccaattaatccaaatgatcccaacgggcctaagtggccaagcgatactgacactaagggattgactaaacaaggtaatcaaactattcattacgtttacgttgatggaaataaggcagctgatgataatgttcaaaatgttacatttgttcatacacttgtatttgataatgtaactggtcaagtgatcgatgataggggatggactcctgaaagtcataagtttaataatgtgttctcaccaacgattgatggccatcatgcagataaaatcgtggttgatggtgttacagtaactgttgataatccaacaagcgaaactactgtggtttatgctaagaatggtcaggtgattcgtgagcagcaagaagttaaagcttcgcagatcgttaagtatgtagatgatgaaggtaatgaattacataaatctgaattgcaagaatttacatttacttatacaggtgatgcttatgatgaagtaactggtgcgaaggttcaaactggtacttggaatgcaataagcacagactttcctgttgttgatgttccagtaattaccggttacgtagctgtttctggctatactaacaataatggaaaatacatggccggaggatttactactactcgtgaatctagtgaagatcaacgtaatcgtgtatttacagttctttacaagaaagttggtaatattgtaccggtaggtccagatggtactacaccaattccagatgcaccaactccgagttacaagaatgatccaacaaatccaactaaggtaatacctgatgaaccggtaccaaaagttccaggatacacaccaaatactccaacagtaacaccaggagatcctactacggatactctagttccatatactccaggaaatccaattacagatcaaaaagctgtagtaaattacattgatgctgatgaaggtaacaaagtaattattagttcaggaaatttgattggtaaagcaggagacaaggtagactataatacttctgatacaatcaaaaatcttgaaaacaaaggatatgtattggttcataatggttttccagatggtgtgacatttgataatgatgacagcaccattcagacttacacagttatcttgaagcatggaacaactactgtaatacctgataaaccaggtaagccaggtgaaccaattaaccctaacgatccagatggacctaagtggccagatacaaccggtaaggataacttgagtaagactggtactcaaactattcattatactggggcaggaaacaatactcctaaggataatgtacaaagctttacctttactagaacagctgtagttgataatgtaactggtaaggtaattagtaccggtgcttggaatgtaaccagtcatacatttggcaatgtagataccccagtggttgagggctaccatgcagataagcgtactgcaggtaatactacaattaccccagaggacttgaataagatcgtaactgtaaactacacagccaacggaaagattattccagtagatccaaatggtaagccaataccaaacgtaccaacgccaacctacccaaccgatccgaatgatccaactaaggtagtgccaaatgaaccggtaccaactatcccaggttacaagccaagtgtgccaacggtgactccaagcgatccaggcaaggatacgccagtaccatacgcaccacaaactacgccagtaacgccgaatataccggtaactccaaatgagccaagtactccaacaacaccagatacatcagctccaacaccgcacggagaagatgtaccggtaacaccgaatgagccagatacaccggctccagcaccacatggtgaaaagccggaagaaccagacagaccagctccagctccacatgcaccaaaggcacctactgctaagggcaataacactccagaaaaggaagataagactgttccaactgcagctgctgtagttaagaatgaacaaactcctgaagcagagcttccacaaacaggtgaaaagaatgacagtgcagctgcaattctaggagcaacggcaggaatgataggtttaatcggattatcaggtgttaagaagaaaaaatca

SEQ ID NO: 28 - protein, 2650 aa, Lactobacillus acidophilus
MISKNNRIKRMEATSERKQHHGIRTLSVGAVSVLLGTTLWISIPTSTVHADEINIDDNQPKTNLESNESASTDHVEKVIVEQNQSSSEGAQQDINAANDVSAQNDQKSVNKINDEIIKNENVDADIKTNTDNSHAETSYGQTESQEIIENKQKTDVEKNKTQTTDNITPVEQTGNSSENTSTNVTTQSPVDNSTNNDVNVNNSNLADTQAELIDSNTQFYESSPLIDQIGQQGKTTVNSSNNTSSKLNIDDLSPDLSDEVLKANLTQGNQILLNQSNSSDTMAGKNADPTKQLEAMARTATLVAASPNADNYTTVNNYNDLQRAVSNYSVSGVNIDGDIYVFGNLTINRAFTIKGTNNAKLNLNQNAIINNSTLTLEDITVNGSIMGNGTVNIKGDVISNVNESNGYTLTNSEKATPGVKVNWTQTKGYNIQSSTVNVDDNASLTINRSSVGDGIHLLSNGIVNVGNYSQLTINMNTNNELGTGATARYHDAGIFAESNGSFTTGYKSVVTLNTSIGQGIAMTGLRPNVTDNDRFGGYTRDRANGAGQINLGQYSTLNFTGRDGVILGNNSNFNVGEYANVHFENKGRGVALDLANNSNINIADHAVTYFHSVGKNTTNAIGVVVGPSGSYEGYNYIGVNEAGNITIGEDATFRVIMENRGDNAWDDVISLDSQLATTNAAFTSKKGAIIDIRDDNTNFYAELISFPLGAANSRIDIQDPLLLNLQRYSAGGETTGWMAGVGGVAINSTSEKYTANLIYMGGTKGVLSIGGTNYVVYQQIKSDGAQQIWTDVDSVEFHKNGFASQDIFNNGANSDVSISGNGFTSGIRANQIRDNQTDPTLVNLQNSPAYGISTMRASHQIWIPHETSTQIKGTHTNTISYVYEDGTPVMGADSQPLVVTQNLNLARDLTLDLTSEQIKTIQDYALGHTADETLNYIRSGYSVTQDSGWTYTNDQGQKVTDPYASVTSPVKEGYIITIQSTNAPGVTLGADGQTVKANFVFDAANDVVQNGQLSAGYRNQGITGIPDNYQTIVVYKKAEKGSVQVIFYDDTTNDAIPSVGFNSGTEEAGTPVTYTTAQNISDLEKQGYVYVSTDGVIPTTIPNNATLITVHMKHGTNPVNPDQPTDKYTKEDLQKTVTRTINYIDTAGNIIADSVTSTVVFTGSGTIDTVTGNLVTVDASGNIVDQNGQLTWTYSVDGDSAQSGNSYTFAETAAKPSIDYNGSTYNFVSVTPGNYSAGNGSVTSYEVNTNNSHDLTVDVIYNEGATYHTGKTDTKNVTRIINYLDGKTDEKIPINLILANPVEQTVSMYRTEILDSTGKVIGYGTVSQDGKMYTLNNNWIIDGIWESVNSPDLTTNGYKAPRFEDSSLAAIVAEYIVNADTKNATVNVYYDHQVIPIGPDTPDKHGVDINQVEKVVKETVHYVGAGDKTPADQVQTSKWIRTVTVDVVTNEVVPDGEFTTDWTIPSDEKSTYDQVDTPVVNGYYADQANVPATAVTQNDIEKTITYKQIGKVIPVDPSGNQIPGIDTPHFPNDPNDPTKVIPGEKPYVPGYHPETGKPGDAVDPAPGDPSKDVEVPYTPETPIVDQKAVVNYIDSDEENKVITSSGDLIGKPGEQIDYTTIPTITDLTNKGYVLIYDGFPTRVTFDDDDGITQIFTVVLKHGTQTVTPEKPGIPGDPINPNDPDGPKWSDETGKDSLIKTGTQTIHYEGAGSKTPTDNVQNFEFTRTAVIDKVTGEVISTSGWNVTSYTFGNVDTPIVEGYHADKRNAGGTTITPDDLNKMLVVRYTPNGKIIPVDPAGNPIPNVPTPQYPTDPTDPTKVVPDEPVPAIPGYRPSTPIVTPTDPDKDTPVPYAPIQGSIQVIFHDDTSNQTIPDVGYNSGVQDEGTRIDYTTNKNITDLINKGYVYVGTDGNVPAEIVADQNITITVHMKHGTTTITPDQPGKPGEPINPNDPNGPKWPSDTDTKGLTKQGNQTIHYVYVDGNKAADDNVQNVTFVHTLVFDNVTGQVIDDRGWTPESHKFNNVFSPTIDGHHADKIVVDGVTVTVDNPTSETTVVYAKNGQVIREQQEVKASQIVKYVDDEGNELHKSELQEFTFTYTGDAYDEVTGAKVQTGTWNAISTDFPVVDVPVITGYVAVSGYTNNNGKYMAGGFTTTRESSEDQRNRVFTVLYKKVGNIVPVGPDGTTPIPDAPTPSYKNDPTNPTKVIPDEPVPKVPGYTPNTPTVTPGDPTTDTLVPYTPGNPITDQKAVVNYIDADEGNKVIISSGNLIGKAGDKVDYNTSDTIKNLENKGYVLVHNGFPDGVTFDNDDSTIQTYTVILKHGTTTVIPDKPGKPGEPINPNDPDGPKWPDTTGKDNLSKTGTQTIHYTGAGNNTPKDNVQSFTFTRTAVVDNVTGKVISTGAWNVTSHTFGNVDTPVVEGYHADKRTAGNTTITPEDLNKIVTVNYTANGKIIPVDPNGKPIPNVPTPTYPTDPNDPTKVVPNEPVPTIPGYKPSVPTVTPSDPGKDTPVPYAPQTTPVTPNIPVTPNEPSTPTTPDTSAPTPHGEDVPVTPNEPDTPAPAPHGEKPEEPDRPAPAPHAPKAPTAKGNNTPEKEDKTVPTAAAVVKNEQTPEAELPQTGEKNDSAAAILGATAGMIGLIGLSGVKKKKS

SEQ ID NO: 29 - DNA, 1038 bp, Lactobacillus acidophilus
  misc_feature (0)...(0): ORF 1018 - mucus binding protein
  CDS (1)...(1038)
ttgattcaatacgtaggtgaaaatggtgaagttataagtgaagatacttttgttggaaaagatcaagaaaaacaagatgttaccataaattatccaaaaggatggattttatcagatcaagaagtaccaactaaaatccaaattaatggtgggattacacaaattcatattaaacatgcaaaaacagtggtaaaagctgatgatccaaaaactactgatgatgttttacctcataatactgatgcacattatccagatggagtgaaaaaagaagatctgaataaaactattacaagaaagatcattatcaatttgccaaatggtgaagtaaagactagggtgcaaatagctaattttactagggatgcggaagttgatgaagctaccggagatattcattatttgaagtggagattggataaaaatgggctaacagaatatctagtgcctaaatatcagggctataaggctaatttggaaaaagttaattatgagataccaaatgtaaatagccactatgatgatttagtgattgaatatgttgctgacaaactttctgatgattcaccaacggattcacatgacgatgttattaatactaactcgagtcttgataattttctgtcagaaaaagatcgagaagataataatagtcaatatgaacgattaaatcaaaatgatgatatatttaatgcaccattaggtaaggcggaagtaccagataaacggtcagataagaagacacaatcatataaaaaccatcataaagtgataagtaatgccaatattactcagtttaacaaatatgaatcttcgaaaaaattaataacaaatgatcggattccaaatagcactgagaaagataaaaaagttaataaagttgaaaatataaaattacgccagaaaatatcatttaaaaatagtacaaaaatattacctgaaactggtgaaaataatcaatatctaccatggatgggtattttactttccatgttggggttaaatggtttagtcgttagacgtaaaaagaagatgaaa

SEQ ID NO: 30 - protein, 346 aa, Lactobacillus acidophilus
MIQYVGENGEVISEDTFVGKDQEKQDVTINYPKGWILSDQEVPTKIQINGGITQIHIKHAKTVVKADDPKTTDDVLPHNTDAHYPDGVKKEDLNKTITRKIIINLPNGEVKTRVQIANFTRDAEVDEATGDIHYLKWRLDKNGLTEYLVPKYQGYKANLEKVNYEIPNVNSHYDDLVIEYVADKLSDDSPTDSHDDVINTNSSLDNFLSEKDREDNNSQYERLNQNDDIFNAPLGKAEVPDKRSDKKTQSYKNHHKVISNANITQFNKYESSKKLITNDRIPNSTEKDKKVNKVENIKLRQKISFKNSTKILPETGENNQYLPWMGILLSMLGLNGLVVRRKKKMK

SEQ ID NO: 31 - DNA, 882 bp, Lactobacillus acidophilus
  misc_feature (0)...(0): ORF 1017 -  mucus binding protein
  CDS (1)...(882)
atgattggtcaaacagatcaaaatatagtcatcacttatagcgctaatattcaacaagttaaaattctatatgttgatgaaaaaggtagtgaagtttcatcaatgttattgaaggggaatactgatcaaacagttaatgtcagttattcagtaccagaccattggatagctatctctggtcaagatagtccattgcaatatacatttaaggcaaaagataataaaaatattgtaattagaattggtcataagttagaagatcaagaaaatgatatccataaaataattcgcaatgttaatattgtgaatcccgatggtagtgtagctaaagtatcgcaaacagctatctttacaagagttcatcaacgtgatgaagtaactggggaagaagtttatggtaactgggataagatatcgcaagattttaatgctatagatatacccaaaatatttggttatactgcaacttcttcagttggaaagatgactgtaactccggattcacagagtgaaaatataactattacttatacggctgatattcaaaataataaaattgtgataattgatgatgaaagccatggatcccaaattaatacagttgggtttactggtaaaactgggaagagtattgcatggcaagtaactataccagaaaattatgatttagctgctggtggtaagatatcagggaattatacttttaatgctgtgaatcaaatcccaattgaagttcatgttcggcataagcatgtacaagatgacgaatctaaatcagttacacgaaccatcgttactaacttgccaggattagataaatctgaaattgttcaaactgtaacatttagtagaattatagataaggatttagtagatggtaat

SEQ ID NO: 32 - protein, 294 aa, Lactobacillus acidophilus
MIGQTDQNIVITYSANIQQVKILYVDEKGSEVSSMLLKGNTDQTVNVSYSVPDHWIAISGQDSPLQYTFKAKDNKNIVIRIGHKLEDQENDIHKIIRNVNIVNPDGSVAKVSQTAIFTRVHQRDEVTGEEVYGNWDKISQDFNAIDIPKIFGYTATSSVGKMTVTPDSQSENITITYTADIQNNKIVIIDDESHGSQINTVGFTGKTGKSIAWQVTIPENYDLAAGGKISGNYTFNAVNQIPIEVHVRHKHVQDDESKSVTRTIVTNLPGLDKSEIVQTVTFSRIIDKDLVDGN

SEQ ID NO: 33 - DNA, 555 bp, Lactobacillus acidophilus
  misc_feature (0)...(0): ORF 1016 - mucus binding protein
  CDS (1)...(555)
atgatctttggtgcagataataaagtagctgcaattaatgcagttgaagtaactagtgatacagctgatattgtagttaatatcacttatgtagccgataatcagtatatgcatatcatctatacggataggaatgatgaagtggttagaattgataaagttagtagtcaaacagatcaaactgtaaatgttaattctaatgtacctaatggttggaaattgctcgataatgaaaaaattccagcaactattcactttactggaacgccaatagctgatatcaagttaacaattgaacatagttttactaaggttactcatgacaagccagttgagttaaatagtaagactattacaggtcaaacaattagtggtgctcatcaaaatgatttgaatcaggtgatcactcgtaaaattacaatatatgaacctgataaaaaggtacaaacaattaaacaaattgctagaatttaccgtaatgccatgatagataatgttactggtaaagtaaaatataatgattggtcaaacagatcaaaatatagtcatcactta

SEQ ID NO: 34 - protein, 185 aa, Lactobacillus acidophilus
MIFGADNKVAAINAVEVTSDTADIVVNITYVADNQYMHIIYTDRNDEVVRIDKVSSQTDQTVNVNSNVPNGWKLLDNEKIPATIHFTGTPIADIKLTIEHSFTKVTHDKPVELNSKTITGQTISGAHQNDLNQVITRKITIYEPDKKVQTIKQIARIYRNAMIDNVTGKVKYNDWSNRSKYSHHL

SEQ ID NO: 35 - DNA, 1524 bp, Lactobacillus acidophilus
  misc_feature (0)...(0): ORF 909 - mucus binding precursor
  CDS (1)...(1524)
atgagcaaaataacatttttttctaaaacaatacatataaaaattaagtttgttgatatggataattggagtccgatccttaagcctattgaagttaaaggtaaagaaggaaaaacaattgattgtagtataaataatcaacttgaagaggcaaaaaaacaaggatatgaacttgctagtaatgaacttgaacaagatggtcagagaaaagaattttctagtgataatgatgaatatataattggctttcatcatggtcaagctattattgatgctatgcatcctggctatggatatacaaagggtcaattagagaaaacaattactcaaatagttcattatcagggagcatcaagtaagacgccaattgacaataagatctcaagagttcttaggcgaaaattaataattgataaagtaaatggaaagataattaatgatagtggctggaataatcaaggatattttaaattgattgctactcctgtggtccctggattcaaagcagatcatttaattgcaggtggtggcaaaattgatccacacaatccggttcaaaactatgtggtagagtatgctttaaataatgagccagtgtctgaaaggcaaactgctaagattcaatacgttgatatattaaacaataatcgggtaatcttaagtgatgaagtggtaggaaaagcaaatgattggattgaatatgatcctcagaatagaatcactgagttacgaaaaaatggatatgaattagttgataatgcgtttaatgcaaatggaaacgttcaattttttggtgatagcaatgaagaatttgttttcatcattacaatgaagcatacctttatcaatgttgatattaagcatccttttgataagatacttcctaaacagtatcttaaagcagttaattttagagtagtttttcaaggggcaggtattttgactccggatgaaattacgcaaacagcaattttaaatagaagtttaaaggtaattcctgaaactggaagagtattatctaaaacaagatggtttagtgatattgactcttttcatgatgttaaagttccagttgttgaaggtttcgtagctgataaactaaaaataaaggcaccagaaatcgtgccaagtgatattatagttactgtcaattatattgatgcgatggtggccaagcttaaaaaagcagaaaaaagattgcaggaacaaaaaaagttagaaatggcaatcataacttttattgatattgacaaaaatggtacacaaattatgacatctggtgcaataactggacaacctggagaaagtattaatgattcttatagtactaaagaacctttaaaaactttgaagaatgaagggtatgaagttgtctttaataatttcgatattccaggtatggttcaacgttttgataataatgatttacagccacaagtatttacaattggcttaaaaaaagtggctcaaatagaatctaatcttaaaattgttagagataagtcagaagcgaccataattaaa

SEQ ID NO: 36 - protein, 508 aa, Lactobacillus acidophilus
MSKITFFSKTIHIKIKFVDMDNWSPILKPIEVKGKEGKTIDCSINNQLEEAKKQGYELASNELEQDGQRKEFSSDNDEYIIGFHHGQAIIDAMHPGYGYTKGQLEKTITQIVHYQGASSKTPIDNKISRVLRRKLIIDKVNGKIINDSGWNNQGYFKLIATPVVPGFKADHLIAGGGKIDPHNPVQNYVVEYALNNEPVSERQTAKIQYVDILNNNRVILSDEVVGKANDWIEYDPQNRITELRKNGYELVDNAFNANGNVQFFGDSNEEFVFIITMKHTFINVDIKHPFDKILPKQYLKAVNFRVVFQGAGILTPDEITQTAILNRSLKVIPETGRVLSKTRWFSDIDSFHDVKVPVVEGFVADKLKIKAPEIVPSDIIVTVNYIDAMVAKLKKAEKRLQEQKKLEMAIITFIDIDKNGTQIMTSGAITGQPGESINDSYSTKEPLKTLKNEGYEVVFNNFDIPGMVQRFDNNDLQPQVFTIGLKKVAQIESNLKIVRDKSEATIIK

SEQ ID NO: 37 - DNA, 1017 bp, Lactobacillus acidophilus
  misc_feature (0)...(0): ORF 1460 - mucus binding protein precursor
  CDS (1)...(1017)
atgccacataaaaatacgaaatctaatgtacaaaaaattactgctagtgtagcttctgtgattgtaagtactggaattgtaatgaattcaagtaatcgtagagttaaagcaactggtaaacgagaagatgaaattgttgaagttgaaagtttgaagagagctgatactgaaacgacgaaggctgctgctgtgcaaactcctaaaataaaccaaactaaaaagatgagtcatcgtactcaaaaggttacacagatgattcactatgtagatgaagatgaaagaccggtttatgatgattacacggctagtttaatttttgaacaaacaggaattctggataatgttactggtaagcagacatggaatagcaattggttaccaaagactacggcaacttttagtgctgtagaacatcccgtggtaagaaatcatcatttagtaaatccagagataaatgaagtaagtgcgtatgatgttgaagtaacggatgatacttttaaaaatcctcttcttaaagttcataaagttgtatatgcacatgatatagaaccaattaaacggacgcaggtagtaacgcaaactattcattatagatatgaagatggggcggttgcacatgatgatcatgttgtgtcattaatatttacacagtcaggtaagagggatttgactaatggtaaagaaatttgggatagtaaatggtcgctgactcaaacttttgaagctttgcctagcccagttattattggatatacagcagataagccgatggttggtcctgatgaggttacggttgatagtaaaaatttccttgataaacaaaatagagaagaaaccgtaatttatagtgcgaatactattacgcaaaataagaaagatgggattagtgaagaaaagaatgtaaataattctgttgctgtcgcgccactaaaaagtgctgtaatgattggcggagtaatatctattttaaaatttaaaagattaatggttattataaaaaacaagaaggatcataaa

SEQ ID NO: 38 - protein, 339 aa, Lactobacillus acidophilus
MPHKNTKSNVQKITASVASVIVSTGIVMNSSNRRVKATGKREDEIVEVESLKRADTETTKAAAVQTPKINQTKKMSHRTQKVTQMIHYVDEDERPVYDDYTASLIFEQTGILDNVTGKQTWNSNWLPKTTATFSAVEHPVVRNHHLVNPEINEVSAYDVEVTDDTFKNPLLKVHKVVYAHDIEPIKRTQVVTQTIHYRYEDGAVAHDDHVVSLIFTQSGKRDLTNGKEIWDSKWSLTQTFEALPSPVIIGYTADKPMVGPDEVTVDSKNFLDKQNREETVIYSANTITQNKKDGISEEKNVNNSVAVAPLKSAVMIGGVISILKFKRLMVIIKNKKDHK

SEQ ID NO: 39 - DNA, 228 bp, Lactobacillus acidophilus
  misc_feature (0)...(0): ORF 66 - steroid binding protein
  CDS (1)...(228)
atgaaacaatttacaaaagaaactctgtcaaattatgatggtaaaaacggccgacctgcttatattgcagttaatggtatcgtttatgacgtaaccaacaatgctcattgggttaacggtgaacaccacggtataagagccggaaaagatgtaagctttgacttaactaatacatctcctcatggagaaaaagtcttagttaatgctaatcaagttggtgtatacaac

SEQ ID NO: 40 - protein, 76 aa, Lactobacillus acidophilus
MKQFTKETLSNYDGKNGRPAYIAVNGIVYDVTNNAHWVNGEHHGIRAGKDVSFDLTNTSPHGEKVLVNANQVGVYN

SEQ ID NO: 41 - DNA, 1065 bp, Lactobacillus acidophilus
  misc_feature (0)...(0): ORF 494 - surface exclusion protein
  CDS (1)...(1065)
atgtctaagaaaatttttactaaattactgaccagtatttgtttaatgggcccaattagcaccactattcaaataacaccacaagtagttcaagcagccagtaataaggtacaagtcaaaggaagtaaaaagatccgcctttataattcaaaaggtaaaaagaccaaatattatgcttatccaggtaaaagatatgcttattctactaaaaagaaattaaagattggcaagaaaacatatttggcttataaattaaatgctaattcatattggctacttgctaaaaatgctaaagttgtaaaaaatactacctcaactgttcctacttcttattctcaagctacgattaaattaccaagcggatatactttatccggcttgcttgaggcttataagggagcgccaagtgaaagctttattgatgcttcaatgaagggaatggagattaataacttttcacgtgttgctaaaggggaaagcagtagtgataaaagggtaattaatcctagcaaattgacagctagcgatcaaaaagaattgactgaatttgcacttaaaataattaatagtgctcgtgagcaacttggtttgcatccttggatttatagctcaggaacacaacaattagccaatgatattgcaaaagaatatcaagataatggtcgcagtattagtgatggagaccattacatttcaggaattgtcagagcatgcaaaaagaacggcttggacttggatgacaattacgtagaggatatggccggtttctcaattaaaaagacaactatgcctatgggtgaaatgaaaaaggatatttacttcggtttaaagcaaatgatatttggttttaccggttcaggtgaaagcactaggaataataagtcattgtatcgtgaatgggaacatgcgggggacctatttaatacacaggattcagttcacgatggagactataactattatggcttcagtatttcaaaaacaggaaatacgtattcaatgcattttattagtgttccaaattttgtggttgaaagtagtaaatataatgttggttttaaacca

SEQ ID NO: 42 - protein, 355 aa, Lactobacillus acidophilus
MSKKIFTKLLTSICLMGPISTTIQITPQVVQAASNKVQVKGSKKIRLYNSKGKKTKYYAYPGKRYAYSTKKKLKIGKKTYLAYKLNANSYWLLAKNAKVVKNTTSTVPTSYSQATIKLPSGYTLSGLLEAYKGAPSESFIDASMKGMEINNFSRVAKGESSSDKRVINPSKLTASDQKELTEFALKIINSAREQLGLHPWIYSSGTQQLANDIAKEYQDNGRSISDGDHYISGIVRACKKNGLDLDDNYVEDMAGFSIKKTTMPMGEMKKDIYFGLKQMIFGFTGSGESTRNNKSLYREWEHAGDLFNTQDSVHDGDYNYYGFSISKTGNTYSMHFISVPNFVVESSKYNVGFKP

SEQ ID NO: 43 - DNA, 333 bp, Lactobacillus acidophilus
  misc_feature (0)...(0): ORF 1587 - tropomyosin-like protein
  CDS (1)...(333)
atgaaacatttcttattaggcacagtttttggtgccgcagcaggattcgtattttcctgcttaacagatagtgatggcaaccgtcccggcaaaccattaaaagatgaatatgatgctattaagcatgaaggcggacgctttagtgatgcattaaaaaaggctaaacaagccagtcacgatttaaatgaacatcttcctgaagcagaacgcacaattagtgatatgaatgatgattttgaaaaatattccaaacacattcagcctattgttgaaaaaatgcaacaaaaaagtgatgaattaaaccaaaatttgaataatttagatacaaaggac

SEQ ID NO: 44 - protein, 111 aa, Lactobacillus acidophilus
MKHFLLGTVFGAAAGFVFSCLTDSDGNRPGKPLKDEYDAIKHEGGRFSDALKKAKQASHDLNEHLPEAERTISDMNDDFEKYSKHIQPIVEKMQQKSDELNQNLNNLDTKD

SEQ ID NO: 45 - DNA, 198 bp, Lactobacillus acidophilus
  misc_feature (0)...(0): ORF 1378 - biofilm-associated surface protein
  CDS (1)...(198)
atgagaagagacttacataatttagacgtaggggacgttaaagaaaaacaacgtttttcaattcgcaagttaactgtaggtactgctagtgtattgctgggtactacattcttgtttggtgcaggtcagactgcttacgctgatactactgcttcaggtgctattactagtgaagattcccaaaaccaaattgggggg

SEQ ID NO: 46 - protein, 66 aa, Lactobacillus acidophilus
MRRDLHNLDVGDVKEKQRFSIRKLTVGTASVLLGTTFLFGAGQTAYADTTASGAITSEDSQNQIGG

SEQ ID NO: 47 - DNA, 693 bp, Lactobacillus acidophilus
  misc_feature (0)...(0): ORF 493 - aggregation promoting protein
  CDS (1)...(693)
ttgaaaatcaaatctatcttagttaagtcaattgcagtagctgctatgtcagttacaggtgtagtagcagcaaataacgtaacttcaaacaatgcacaagctgctactgttcaaaatgatgctagcgtagttacagtaaactacgttgcaaacaactcaatcaacgtatacaacaattacgaaaacccagtagcaacaggtcaaattttagcaagtaatacttcatggaaagttattaagactgcttacgactcaaagggtaacaaatggtacgacttaggcaagaaccaatgggttcgtgctagtcaagtaaccgctggatacactgcttcagcaacaactactgcacaaacacaacaatcaactactactcaagtagctaatactcaacaatcatcacaagtagcaactcaatcacaaactgcagctgcttcaactactagtgcttcatcatatacttcaagtgcatctggttcagaagctagtgctaaggcttggattgctggtaaggaatcaggtggctcatactcagctactaatggtcaatacatcggtaagtaccaactttcagcatcatacttgaatggtgactactcagcagctaaccaagaaagagtagctgataattacgtacaaagtcgttacggttcatggactgctgctaaggcattctggcaagcaaacggctggtac

SEQ ID NO: 48 - protein, 231 aa, Lactobacillus acidophilus
MKIKSILVKSIAVAAMSVTGVVAANNVTSNNAQAATVQNDASVVTVNYVANNSINVYNNYENPVATGQILASNTSWKVIKTAYDSKGNKWYDLGKNQWVRASQVTAGYTASATTTAQTQQSTTTQVANTQQSSQVATQSQTAAASTTSASSYTSSASGSEASAKAWIAGKESGGSYSATNGQYIGKYQLSASYLNGDYSAANQERVADNYVQSRYGSWTAAKAFWQANGWY

SEQ ID NO: 49 - DNA, 360 bp, Lactobacillus acidophilus
  misc_feature (0)...(0): ORF 1850 - lysM or aggregation promoting protein
  CDS (1)...(360)
atgagtaaaaacgttaaatctactttggttaaaatttttgcagctttagcacttgcctttgcatgtgttactgttgcccaagctttttctaccacttcaaataaccaaactgtacaagccgcaactagaaagctttctaagaaggaaaaggcagctaagcgttggatcgcaatgcgtgaatcaggtggtagctacactgctagaaacggtgtttgttacggtaaatatcaattaaatattggttacttaaacggtgatttatcacctaagaatcaagaacgtacagctgataattacgtttatggtcgttacggttcatgggttaatgccaagagattttggctagcacataattggtat

SEQ ID NO: 50 - protein, 120 aa, Lactobacillus acidophilus
MSKNVKSTLVKIFAALALAFACVTVAQAFSTTSNNQTVQAATRKLSKKEKAAKRWIAMRESGGSYTARNGVCYGKYQLNIGYLNGDLSPKNQERTADNYVYGRYGSWVNAKRFWLAHNWY

SEQ ID NO: 51 - DNA, 792 bp, Lactobacillus acidophilus
  misc_feature (0)...(0): ORF 1495 - fibrinogen-binding protein
  CDS (1)...(792)
atgtttagagacaaaaaaacacaatttgctattagaaaactaacaacaggtactgggatcctgttgttaagtgttggtatggggattaacttatcctcaaaagaagtatctgcttcagaaattgatccagctcaaactactgagactgttcaaactgaagctgcgacagaattaaccgcggaacaagaaccagctgttgaattctctgccccagttcaagaaactgaaggtacctctacagttgaatcaacacctaatgttaaggaagagactgttacagagataccagcagaaactgttactggcaacactaataatgaaaataacggcagtgtaaacacaggaactcaatcccctgctactcaacctgaagctgaaaagccaggtcaagacactaccgctactgacaatactaataatgaaaataaagatgctgtaaatacagaaactcaaaaaccagagactactactcctgctacccagcctgaaactgataaagcagaagaaggtgaaaaaactccagctaaaaacgaaactgactcttcatcagaaaaagaagaatccaaagctgattcagataaaaaagatgaagtagaaaaaaatgaaaatgagttaaataaaggaaacataaaagatgacgccattaacattgatggttctatccttcctgacgcagctaagcctgataaagataatattaatgagactttatcaattcaattctttctgatccggataaacttgcagaatttgaaggaaaagctaattggacagatgctatattgcaaggaa

SEQ ID NO: 52 - protein, 264 aa, Lactobacillus acidophilus
MFRDKKTQFAIRKLTTGTGILLLSVGMGINLSSKEVSASEIDPAQTTETVQTEAATELTAEQEPAVEFSAPVQETEGTSTVESTPNVKEETVTEIPAETVTGNTNNENNGSVNTGTQSPATQPEAEKPGQDTTATDNTNNENKDAVNTETQKPETTTPATQPETDKAEEGEKTPAKNETDSSSEKEESKADSDKKDEVEKNENELNKGNIKDDAINIDGSILPDAAKPDKDNINETLSIQFFLIRINLQNLKEKLIGQMLYCKE

SEQ ID NO: 53 - DNA, 2973 bp, Lactobacillus acidophilus
  misc_feature (0)...(0): ORF 1496 - fibrinogen-binding protein
  CDS (1)...(2973)
ttgcaaggaataattaagtggatagaagataatagactttcatgggatcacattagtgatcaagaaaaataccctggatgggaagatgtttttgatgaaagtttaaaaatcgacagagttgatccttttgatcataaaaatccccaatggcaagcaactgcaaacaaagaaattactattacccaaacagtaaataacggttcacagcaatccacacaacaaatcaaagttaactacgatgtagtcatatatattgcgattgatcctaatatgagcggatgggatgcactttttggtaattataaatttataattagcgatgtaaaagtcagcaacattaataaagtagaccctgatactaatactccgaaagatgattttgatgcagtaaatattcctactgctccagaaggctttgaaaacagagtcacaggcacaattgaaggacccaaatttgatgattacaatataaacaataatatcagccttgaagacaaagtaattaaaactaatttagatagtatcttcaataccatcctacaaaaaggtacagatgtaacctttaaatacgatattgaacaaattgccgttaaaaaaccaacttgggttgatgtcattgatggtgatgacaaaaaggagtggaatgatctcttccaaaatgttgatttcactaaagaccaagataaagataatatctggaccggtacagtaactttaaataaagatatcattcaaaccattaatggattagatcaagaaaacaagcaaacaatccaccttacaaaagatgtcactattactattcaacgtgatggtaatactaataacttcaaaattttgacagtaaatcaatctaattggacaccaaatgattctcttgaatctacagatatctctaagccaggctacaatcacaatgtgtctgcttctattactggtaccagtagtgacaactttacacataaagttgaaaatggtcatctttcaacgaatcttgattttagtaaattagaaaataacaataatcaaattactatcaactacaaagtgtcttattctcctaactttggcgatattgccttacctccaaacatggacctagatgacttgaagccagataaagataatgaaaatatttttactggcactattaccactgataaagtaatcaatcaaactgttaacggcaaacctgctaatgatattactttctcacaaactgtttcagttacagttacctgggacaaggaaaatgctcaatgggtagtctcagaacctaaggttgagattaatggttatactccaatcgacattaataagcctggttactccatcgacaaggttgaagctgatattattggtgaatcagactttaaggttgaggatggtaaacttgtagttaatgacaaggctttggctaaccttcaaaacggccaaaccatcaactacaccgtgacttactctcctgtatttggcgatatcatcttacctccaggcatcgacaaagatgacttggttgaaaatcctgatggttcttggactgctaacaccactattaataaagtcattactcagaatatcgctaacgctaatggcaacattaaccagattaccctatcacaagcagctacagttacacttaccttaaaagacgggaaatggactgtagacattaagggcttcggtgatgttactgttaaggatgacaatcctattaacgttaatagacctggatacaagcatgacgtatctgcttctatcgatggcactaagtttgatggattcaagatcgatgacgatggtaatatcgtaattaatgccagtgcttgggacattcttaaagatggcgacactatcagttacatcgttaactacactcctattaagcctcaaccagatacagtaactcctcctaacaaggatgacgacaacatttggtcagatgatgttacagataaggaaaaagacgacatcatcgataagatcgaagacggggcccttacttggacagataatggagatggcacttggtctgcaactgttgactttaacaagcaactctcacaatccatttctggtaatatgatcaatggtttaccaaacatcacagtagacgttactaagaaagttacattaactgctgaacttaaaggtgataaattccatattactagcgttacatcaggtaaatggactagcgacagtaacttaggacagaaattacctgaatctgacaacaaatatgacatttctgccactgttaatggtaatgatcatgctggattaaaagcagaagttgaaaatacaaacacaattccaggtcttgattctgacttgattcaaagtattattaacaaccatgaatatggctcacttctccaattaagctatgtcattaacgctaaccccggttctgctgatcccgacaagccagctgaacctgacactcctaatgtcgatcctgacatgggtgtagatccagaaaatccatctaatcctgatgataacaatggctcaggtgactcaaataactcaggcaataatcctggctcaagtgattcaaccgaaaatactacacctaagcctgaagaaggaccagaagttaaaccagttacaactccaactgaattcacccctccgctttctgaagatatagaagatgatgataaaaaagcaaatccagattcagattctgctcaatctgaaagtaacaaggataataaaggcaaaactgtcactggtagcaaagctacaggcaagaaggcaactattatttcactttcagaatcaataactgcttctcaaaacagtagtgctaactcacaaaatagcttagctacaactgataacgagatagcattaccacaaactggtgaaaataaggataacctttctatgatgggtattattatggctggacttgctggtgcactcactactttaggcacagctatcaagaaaaagaagaagaac

SEQ ID NO: 54 - protein, 991 aa, Lactobacillus acidophilus
MQGIIKWIEDNRLSWDHISDQEKYPGWEDVFDESLKIDRVDPFDHKNPQWQATANKEITITQTVNNGSQQSTQQIKVNYDVVIYIAIDPNMSGWDALFGNYKFIISDVKVSNINKVDPDTNTPKDDFDAVNIPTAPEGFENRVTGTIEGPKFDDYNINNNISLEDKVIKTNLDSIFNTILQKGTDVTFKYDIEQIAVKKPTWVDVIDGDDKKEWNDLFQNVDFTKDQDKDNIWTGTVTLNKDIIQTINGLDQENKQTIHLTKDVTITIQRDGNTNNFKILTVNQSNWTPNDSLESTDISKPGYNHNVSASITGTSSDNFTHKVENGHLSTNLDFSKLENNNNQITINYKVSYSPNFGDIALPPNMDLDDLKPDKDNENIFTGTITTDKVINQTVNGKPANDITFSQTVSVTVTWDKENAQWVVSEPKVEINGYTPIDINKPGYSIDKVEADIIGESDFKVEDGKLVVNDKALANLQNGQTINYTVTYSPVFGDIILPPGIDKDDLVENPDGSWTANTTINKVITQNIANANGNINQITLSQAATVTLTLKDGKWTVDIKGFGDVTVKDDNPINVNRPGYKHDVSASIDGTKFDGFKIDDDGNIVINASAWDILKDGDTISYIVNYTPIKPQPDTVTPPNKDDDNIWSDDVTDKEKDDIIDKIEDGALTWTDNGDGTWSATVDFNKQLSQSISGNMINGLPNITVDVTKKVTLTAELKGDKFHITSVTSGKWTSDSNLGQKLPESDNKYDISATVNGNDHAGLKAEVENTNTIPGLDSDLIQSIINNHEYGSLLQLSYVINANPGSADPDKPAEPDTPNVDPDMGVDPENPSNPDDNNGSGDSNNSGNNPGSSDSTENTTPKPEEGPEVKPVTTPTEFTPPLSEDIEDDDKKANPDSDSAQSESNKDNKGKTVTGSKATGKKATIISLSESITASQNSSANSQNSLATTDNEIALPQTGENKDNLSMMGIIMAGLAGALTTLGTAIKKKKKN

SEQ ID NO: 55 - DNA, 2718 bp, Lactobacillus acidophilus
  misc_feature (0)...(0): ORF 1612 - fibrinogen-binding protein
  CDS (1)...(2718)
atggtttctaaaaagaatatcaagatgattgaagagaaaagtagagatgaaaagcaacgcttttcaattcgtaagttaagtgtgggtgcggcttccgttttaattggattggcttttacagtatatggaggtcaaactgtacaagctgacaccactgaagctagtcaagtaaccactgctcaagaaaacaatgaagagactggtaatgaaaagtccgaaaatacagttttggataattcaaacgatatagaaaatagtgcaactacagccagtaaaaccccaagttcaagtgttgaagaaaaagctccttcaataactattgatgcaagtagttctttaaaaaataaaaacgataatattgaagttaaagatgataatgctaaggttaataaaactatgcaatcatcttcagttgataaggcaaataatgtaacttcaaatgaaaaaacagaaagtcaacaggctgtaaatactaaagaagataatccaactaagagtgaagatactaaaaaagtaaattctactgctattaatgtagggtctaatgaaaatacagaggttgcttctgctcaacaaacaaataattttgaagtagataagggtactacttttgctactaatgaaaaaacagaagcaaattcaactaatgtttcagaaaatgttgattcgattgaagtaccttcaaataagttaacaactgacactctaaatatttctaagaaaacagtatctgctaatgtgactaatgccgtttatacaatgaaaacagtaactagtaatgcggcaaatgatgtaaataaaaacaaattgcgttcaacaactatgatattagctgctgaagtagaagatcctaatgcagtaactgttagtgatgcgaaaggatttattaatgcaattcaaaatgggactgctactactattaatgttgctaaagatcttaatttagcagaacaaacagataaagaatatacagaaattaccatcaagaataaacgtaatattgtaattcaatcagataatccagaagaaaaacgtacaattgacttctcgggatattcatttgatatggatacacagaattctgtaacctttaaagacttgaatatttatgctcgtagttactggggtcttgtttataatgctggtggatacacatttgataatgttaactttacgggttcacaacttatctataccaaaccatggattaattcaaccttaacatttaagaataatattactgcaaattctgtctcatcatatgtaggaccacttgatggtaagacacgcgatactcaacaaaatggtgggcagcaaattcttcaatttgaaggtggaacaaatcaaattatttttgatgaaaacagtaatgtaaccttaacaacagaagatgctaatgctcttgaaattgacggcggcaccgcaacaattgatgtaaaagacggtgcaaatgtagcaattaatccacattctaaaggtaatcctgaacatcgtaatggaattggaactggggacgttgcacgtgctattgctgccaatgcaaagatgacaattaatattgatccaaattcaactttaactattaatactgaaaaggtagatggcgataaagatgttgcaggagcattatatttaaattctgaggctgcccttaatgtaaatggtaaattagttatcaactcaaatggaacaccaagtgcaaataaaagtaacggggttccagtatatattaatggaagtgcaaagattaatgttggaaatggtggtagcttctcattagatgctacaaatcttggaaattacagctctagcctaatttctattaatggtaaggggactgttaagttagatcctcactctagtttcaagattagcggtgacggtactggaaatgtaactgcaattaatctttcaagcggtagtactttcacttccgatcaaccagattcatttactattgatctttctgcaaataccagtactggcaaatcattaattaaaaacggagccatcaatttcacccgtgttaagacagttactgatggaagcgaatcacagcctttaggcaaaattgatgtaacttatgatagaaatggtaatgctacttcttacattattacggcacaagatgaaaatactgttaaacaagttggagaaggtcttgctaataagaacttgattgatcttgttaaggctggtgaagatgttactctatctaatcttcatttaagtaagaataatgtattgactggtactgtggcttcaagcggtagcaacaatccaatttatgtaactgttaccgttggtggggtaagcactaatgtgccagtagccggaaattatactgtgtacaccaacactaaaggcacagtaacttcaaacaatattgcttacgctgcacaaactgcttcaactggtggtaatttctctattgatttatccaagcttgcaagcaagttgactgatgatacgcaagttaaagtgactgctacaaaagatttcgttgaagcaactcaaattgaaagtgtggcagcattacgtgcgcttaatactactactcttcaagaattagtagatgctgctccagcagaagaagcaaagccaagctactacaatgcaactgcagaagcccaaaaggcatatacggatgcaatttcaactggtaaactattcttgctaatccaaataattacgatcaagttgacgttgatgatgccg

SEQ ID NO: 56 - protein, 906 aa, Lactobacillus acidophilus
MVSKKNIKMIEEKSRDEKQRFSIRKLSVGAASVLIGLAFTVYGGQTVQADTTEASQVTTAQENNEETGNEKSENTVLDNSNDIENSATTASKTPSSSVEEKAPSITIDASSSLKNKNDNIEVKDDNAKVNKTMQSSSVDKANNVTSNEKTESQQAVNTKEDNPTKSEDTKKVNSTAINVGSNENTEVASAQQTNNFEVDKGTTFATNEKTEANSTNVSENVDSIEVPSNKLTTDTLNISKKTVSANVTNAVYTMKTVTSNAANDVNKNKLRSTTMILAAEVEDPNAVTVSDAKGFINAIQNGTATTINVAKDLNLAEQTDKEYTEITIKNKRNIVIQSDNPEEKRTIDFSGYSFDMDTQNSVTFKDLNIYARSYWGLVYNAGGYTFDNVNFTGSQLIYTKPWINSTLTFKNNITANSVSSYVGPLDGKTRDTQQNGGQQILQFEGGTNQIIFDENSNVTLTTEDANALEIDGGTATIDVKDGANVAINPHSKGNPEHRNGIGTGDVARAIAANAKMTINIDPNSTLTINTEKVDGDKDVAGALYLNSEAALNVNGKLVINSNGTPSANKSNGVPVYINGSAKINVGNGGSFSLDATNLGNYSSSLISINGKGTVKLDPHSSFKISGDGTGNVTAINLSSGSTFTSDQPDSFTIDLSANTSTGKSLIKNGAINFTRVKTVTDGSESQPLGKIDVTYDRNGNATSYIITAQDENTVKQVGEGLANKNLIDLVKAGEDVTLSNLHLSKNNVLTGTVASSGSNNPIYVTVTVGGVSTNVPVAGNYTVYTNTKGTVTSNNIAYAAQTASTGGNFSIDLSKLASKLTDDTQVKVTATKDFVEATQIESVAALRALNTTTLQELVDAAPAEEAKPSYYNATAEAQKAYTDAISTGKLFLLIQIITIKLTLMMP

SEQ ID NO: 57 - DNA, 1698 bp, Lactobacillus acidophilus
  misc_feature (0)...(0): ORF 1148 - fibronectin-binding protein
  CDS (1)...(1698)
gtgatatacatggcatttgacggattatttatccatagtttactacaagatttgacccctacattagtagatggtcgattatcaaaaatttaccaaccatttgaacaagatctaatattaacttttagaaaaaatagaaagaattatcaattattaatttcagccaacgctcaatatcctagaatgtatttaactgagcagactattgctaatccagacaaagcacctatttttgttatggttttaagaaagtatttggaaggttcagtcttacaatctattgaacaaattggtgtgaaccgaattataaaccttcatttcagtaatcgaaacgaattaggtgatcaagtaaaattagtattatccgttgaattaatgggacgacatagtaatgtaattctctatgatcaacagaatggtcatattattgatctattgaagcgaataaatcctgatgaaaatagagctcgtattttattacctaaggcaaaatatgagcttccccctcttaaacctggtataaatggtttagtagtaactgaaaatcaatttaaaaagttaagcaatgaaaaaagcattccagatttagtgaaatcaatggatggtttagacagagacgatcgtgaagaattaactggttatcttgaagatgattttagctattcttcatttaagactttctttgatcagtttaataatccaagagctttcgttttaaaaactccaagaaataaacgtaagattttctgttatcttccctatcatttagatttagagaaagaaaattctaatcctgatttaaataaaggtttagatgaattttatgaataccaagcaacacgtgattgggttaaacaacgtgctagtcaggttgaacgtgtcgtcaaaaacgaacagaacaaactaagtaagaagattaagaaattagaaaagcaattaaacttagcagaaaattctgagggctatcgtatcaagggtgaaatattaaatgctaatttaggacaagtaaaaccaggaatgactgaggtttccttacctaactattatgaaaataataaacctataagcattaaacttgatccagctttatctccggctcgaaatgcacaaaaatatttcactcgctataaaaaattacgtgattctatcaaacacgttaacgaacaaattaaaatcgctaaagaaaatcttcgctattttgattctatccaaacagctattgataatgctgatccacaagatattgatcaaataactgacgaattgattaatcaaggttatattagaaagcaacaaaaaaatagacgtaagaagaaaattactgaacgcaatctaaatgaattccagctttcttctggaaaacatgtcttagtgggtaaaaataattaccaaaatgactggcttactctaaaaaaagctaataaattagattattggttccacgttaaaaatatgcctggttcacatgttattttgcgagatgatcaacctaccgatcaagatattaaagaagctgcagagattgctgcatttttctctaaagccaaaaattctgcccacgttcaagttgactacgttcaagataagcgtgtaaagaagcctaatggggctaagccaggattcgtaatttacacaggacagaattcaatcgaagttacacctaaagaagacgaaattatggctaaaaaaatcaataaa

SEQ ID NO: 58 - protein, 566 aa, Lactobacillus acidophilus
MIYMAFDGLFIHSLLQDLTPTLVDGRLSKIYQPFEQDLILTFRKNRKNYQLLISANAQYPRMYLTEQTIANPDKAPIFVMVLRKYLEGSVLQSIEQIGVNRIINLHFSNRNELGDQVKLVLSVELMGRHSNVILYDQQNGHIIDLLKRINPDENRARILLPKAKYELPPLKPGINGLVVTENQFKKLSNEKSIPDLVKSMDGLDRDDREELTGYLEDDFSYSSFKTFFDQFNNPRAFVLKTPRNKRKIFCYLPYHLDLEKENSNPDLNKGLDEFYEYQATRDWVKQRASQVERVVKNEQNKLSKKIKKLEKQLNLAENSEGYRIKGEILNANLGQVKPGMTEVSLPNYYENNKPISIKLDPALSPARNAQKYFTRYKKLRDSIKHVNEQIKIAKENLRYFDSIQTAIDNADPQDIDQITDELINQGYIRKQQKNRRKKKITERNLNEFQLSSGKHVLVGKNNYQNDWLTLKKANKLDYWFHVKNMPGSHVILRDDQPTDQDIKEAAEIAAFFSKAKNSAHVQVDYVQDKRVKKPNGAKPGFVIYTGQNSIEVTPKEDEIMAKKINK

SEQ ID NO: 59 - DNA, 1332 bp, Lactobacillus acidophilus
  misc_feature (0)...(0): ORF 169 - s-layer slpA
  CDS (1)...(1332)
atgaagaaaaatttaagaatcgttagcgctgctgctgctgctttacttgctgttgctccagttgctgcttctgctgtatctactgttagcgctgctactactattaacgcaagttcatcagcaatcaataccaacactaatgctaagtacgatgttgatgtaactcctagtgtttctgcagttgctgcaaatactgctaacaacactccagctattgccggtaaccttactggtactatttcagcaagttacaatggtaagacttatactgctaacttaaaggcagatactgaaaatgccactattactgctgctggtagcactactgccgttaaacctgctgaattagctgcaggtgtggcttacactgtaactgttaacgatgtttcatttaacttcggttcagaaaatgcaggtaagactgttacccttggttcagctaactcaaatgtaaaattcaccggtacaaacagtgataatcaaactgaaactaatgtttctactttgaaagttaagttagaccaaaacggtgttgcttcacttactaatgtttcaattgcaaacgtatacgcaattaacactactgataacagtaacgtaaacttctacgacgtaactagtggtgctactgtaactaacggtgccgtttcagttaatgctgataaccaaggtcaagttaatgttgcaaacgtagttgcagcaattaattcaaaatactttgcagcacaatacgcagataagaagttaaatactcgtactgctaatactgaagatgctattaaggcagccttaaaggaccaaaagattgatgtaaactcagtaggttacttcaaagcacctcatactttcactgttaacgttaaagcaacttcaaatactaatggtaagtcagctactttgccagtagttgttactgttcctaatgttgctgagccaactgtagccagcgtaagcaagagaattatgcacaacgcatactactacgacaaggacgctaagcgtgttggtactgacagcgttaagcgttacaactcagtaagcgtattgccaaacactactactatcaacggtaagacttactaccaagtagttgaaaacggtaaggctgttgacaagtacatcaacgctgcaaacatcgatggtactaagcgtactttgaagcacaacgcttacgtttacgcatcatcaaagaagcgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 60 - protein, 444 aa, Lactobacillus acidophilus
MKKNLRIVSAAAAALLAVAPVAASAVSTVSAATTINASSSAINTNTNAKYDVDVTPSVSAVAANTANNTPAIAGNLTGTISASYNGKTYTANLKADTENATITAAGSTTAVKPAELAAGVAYTVTVNDVSFNFGSENAGKTVTLGSANSNVKFTGTNSDNQTETNVSTLKVKLDQNGVASLTNVSIANVYAINTTDNSNVNFYDVTSGATVTNGAVSVNADNQGQVNVANVVAAINSKYFAAQYADKKLNTRTANTEDAIKAALKDQKIDVNSVGYFKAPHTFTVNVKATSNTNGKSATLPVVVTVPNVAEPTVASVSKRIMHNAYYYDKDAKRVGTDSVKRYNSVSVLPNTTTINGKTYYQVVENGKAVDKYINAANIDGTKRTLKHNAYVYASSKKRANKVVLKKGEVVTTYGASYTFKNGQKYYKIGDNTDKTYVKVANFR

SEQ ID NO: 61 - DNA, 1371 bp, Lactobacillus acidophilus
  misc_feature (0)...(0): ORF 175 - s-layer slpB
  CDS (1)...(1371)
atgaagaaaaatttaagaatcgttagcgctgctgctgctgctttacttgctgttgctccagttgctgcttctgctgtatctactgttaacgctgccgctgttaatgctattgctgttggcggttcagctaccccattaccaaacaactcagatgtacaaattagttcatcagttgctggtgtaactactaagaatggctcaagctacactaacggtagaatttctggttctatcaacgcttcttacaacggtacaagctattcagcaaactttagttcatcaaatgcaggtgttgttgtttcaactccaggccatactgaacttagtggtgaacaaattaacggtcttgaaccaggtagtgctgtaactgttactttaagagatggtgtttcatttaactttggttcaactaatgctaacaagactattactttagcatttccaaagaacgtatcagctgctggtttagctgatgctaacaaggtttcagctacttcagaaacttcagttgatgcaggcaagactatccaagttaagactgacaagaacggtgttgtaagcttcggttcagcacaagttcttaacgttaaggttgttgaaactagcgacgttagagctgtttcattctacgacatccaaactggtaagactgtagaaaacggtactctttcaatcgttgctggttctaacgcacgtgctaacgtacaagaaatcgttaacgcatttaacgctaagtaccaagcttctcaattgaacaacgctaacagcaatgctaacgttcgtttgactgacaacaacgctcaagctgttgctactatgttaagagctcaaaacattgatgttgatgcacaaggttacttcactgcaccagcttcattgagcttaactttccacgcagaatcaactcaaaacaatgaaactgcacaattaccagtaactgtttcagtaactaacggtaaggaagttactccttcaactgtagacagcgtaagcaagagaattatgcacaatgcatactactacgacaaggacgctaagcgtgttggtactgacagcgttaagcgttacaactcagtaagcgtattgccaaacactactactatcaacggtaaggcttactaccaagtagttgaaaacggcaaggcagttgacaagtacatcaacgctgcaaacatcgatggtactaagcgtactttgaagcacaacgcttacgtttacgcatcatcaaagaaacgtgctaacaaggttgtattgaagaagggtgaagttgtaactacttacggtgcttcatacacattcaagaacggccaaaagtactacaagatcggtgacaacactgacaagacttacgttaaggttgcaaactttaga

SEQ ID NO: 62 - protein, 457 aa, Lactobacillus acidophilus
MKKNLRIVSAAAAALLAVAPVAASAVSTVNAAAVNAIAVGGSATPLPNNSDVQISSSVAGVTTKNGSSYTNGRISGSINASYNGTSYSANFSSSNAGVVVSTPGHTELSGEQINGLEPGSAVTVTLRDGVSFNFGSTNANKTITLAFPKNVSAAGLADANKVSATSETSVDAGKTIQVKTDKNGVVSFGSAQVLNVKVVETSDVRAVSFYDIQTGKTVENGTLSIVAGSNARANVQEIVNAFNAKYQASQLNNANSNANVRLTDNNAQAVATMLRAQNIDVDAQGYFTAPASLSLTFHAESTQNNETAQLPVTVSVTNGKEVTPSTVDSVSKRIMHNAYYYDKDAKRVGTDSVKRYNSVSVLPNTTTINGKAYYQVVENGKAVDKYINAANIDGTKRTLKHNAYVYASSKKRANKVVLKKGEVVTTYGASYTFKNGQKYYKIGDNTDKTYVKVANFR

SEQ ID NO: 63 - DNA, 1701 bp, Lactobacillus acidophilus
  misc_feature (0)...(0): ORF 223 - s-layer protein slpB
  CDS (1)...(1701)
atgcgaggtatattatcgatgaaattaaatcataagttgattatggtatcagcagctgcattaatgagcgtaagtccatttgtaggtactgtgcaaaatgttcaagctgctactactaaatcatcaagcaaaactactgctaagaagactacttcagcttcaaagactaagactaagtcttcatcaaagaaggctactagtcaatctacttcaactaagaagacaagttcaacaaaatcaagctctaagactacttcttcaactagtgcaaagagtacttcaactaagaaggcagcttcaaacactattaagttagttcacaatgcttatgtttatgacaagaatggtaagcgtcttactaagtacatgggcagtgcaaagtacactactattgctaaaggtgtaactcttaagtctaatggtacagtgaagatcgatggtgttctttactacagcctcggtaataatgcctatattaaggctgttaacgtagatggcccatctgcttcagcttcatcaactactaagaagccatcttcaagtacttcttcaacagtaactgctgtaagcattaagattgctcgtaattcatacgtttatgatgaaaatggtaagcgtattaaaaagtatgaaggtaaagataaacttactaagggtactactgttgattcatacggtacagaaactattgatggtaagttatactaccaacttaataaaaagggtacagcttttgtaaaggcaagtaatgtagatacaaatgaaacagctactattactttaaagaagaatgcctacatttatgatggcaatggcgatactaagaaaaagaaaattaagaagggcaagagtgtaaaggctactgaagcaagatacattggtactaagctttactacaagattggtgatgatcaatttgtaaaggctgctaatgtgggtaaagtttcaggtgctaagcttgatcctatcaatgaaccagatggagaagcaactgttgatgatccatcgactgataatgttaacccagatgtaactaaggtaactaccattggtgtaactccactttacaatattaagggtcaaaaagacgacaccagattatttggtgctggtcaaagtcaacaagtttcagaattaagatatattgcaacttcagcaaacggtaccccagacttgttctacaaattagctagtggtagaggttacttgaaggctagtgatgtaattgttagtggtaagactttgtcacctgttaatactccagaacaagctaaggctgatgtaactgttgcaactgcagcagataagactaagttgtcagaaagtattaataattctaagaacgttaaaaattctactacttacaagctttcatcatcagacttaagaaataactatgataaggctgtttctgatgcaactgctgttaataacaatgcttcagcaactattgctcaagttaatgaagcagtagctaacattaatgaagcttacgctaagcttaacggtcaaaaaatagttgtagctaacttaagtaatcttactttagatgaagccaaccaaattgttaagttagttgctagtgtaagaaacgttccagaaagtaatgttcaattctcaaataacaacactactttagcaatcgtttcatcaaatggctacaatgaacctttgaatattagcgactttgctcaacaaaga

SEQ ID NO: 64 - protein, 567 aa, Lactobacillus acidophilus
MRGILSMKLNHKLIMVSAAALMSVSPFVGTVQNVQAATTKSSSKTTAKKTTSASKTKTKSSSKKATSQSTSTKKTSSTKSSSKTTSSTSAKSTSTKKAASNTIKLVHNAYVYDKNGKRLTKYMGSAKYTTIAKGVTLKSNGTVKIDGVLYYSLGNNAYIKAVNVDGPSASASSTTKKPSSSTSSTVTAVSIKIARNSYVYDENGKRIKKYEGKDKLTKGTTVDSYGTETIDGKLYYQLNKKGTAFVKASNVDTNETATITLKKNAYIYDGNGDTKKKKIKKGKSVKATEARYIGTKLYYKIGDDQFVKAANVGKVSGAKLDPINEPDGEATVDDPSTDNVNPDVTKVTTIGVTPLYNIKGQKDDTRLFGAGQSQQVSELRYIATSANGTPDLFYKLASGRGYLKASDVIVSGKTLSPVNTPEQAKADVTVATAADKTKLSESINNSKNVKNSTTYKLSSSDLRNNYDKAVSDATAVNNNASATIAQVNEAVANINEAYAKLNGQKIVVANLSNLTLDEANQIVKLVASVRNVPESNVQFSNNNTTLAIVSSNGYNEPLNISDFAQQR

SEQ ID NO: 65 - DNA, 531 bp, Lactobacillus acidophilus
  misc_feature (0)...(0): ORF 221 - s-layer
  CDS (1)...(531)
ttgggcaacggtcagtatattaaggctaaaaatgtggatggaactggttcgattaaagctcatgtagaagtaactcctagatcctctggcgctacacccacagattatagtaagccaactttaactttgaaaagtaatgcatatccatataatttaaatggtgaacgaattaataattatttaggctttacctatatcaaaaaaggtgccacacttaactatcagggctctgagagaatcaatggtcagaattattattatattggcgatggtgcttatattaaaaacacaacggttggatcaactaataatacaaatgcagcacacaataatactattaccttaaataaaaagacctatgcctatactgcatctggtaaaaagatgtctaaatacttgggatatacttatataaataaaggtaccacattaaattattacggcactaaaaagattaagggaaaaacattttattatattggcgaccatgcatacgtgaacgccgcaaatgttggtaaagttactaatgaa

SEQ ID NO: 66 - protein, 177 aa, Lactobacillus acidophilus
MGNGQYIKAKNVDGTGSIKAHVEVTPRSSGATPTDYSKPTLTLKSNAYPYNLNGERINNYLGFTYIKKGATLNYQGSERINGQNYYYIGDGAYIKNTTVGSTNNTNAAHNNTITLNKKTYAYTASGKKMSKYLGYTYINKGTTLNYYGTKKIKGKTFYYIGDHAYVNAANVGKVTNE

SEQ ID NO: 67 - DNA, 519 bp, Lactobacillus acidophilus
  misc_feature (0)...(0): ORF 220 - s-layer protein
  CDS (1)...(519)
ttgatgcagatgaatcgtaagattattatggcttcagttgccgcaataatagggattgggagcattattggtataaatacagcaacatctggtgaaaatgtggtttatgctagtgtttataaaactacaggtaacaataaagtaaaagttgttaagagtactagttttgtgaataatcgaggtgtaaagcaggctataagtgccgagaagggtggtagctatactgtttatgcagttaactatattgatggtgttgcctacgtaagtgttcataaaagtaatcgatattggttaccggtttctgcggtaaaaggcaagatcttttatcaacgtggtagggataatgctacttatatgattagtgcaggaaataactctgatactgtatctttacaaacaaataataaaggaaacgtaactttaaaatctaacgcttatgtatataatttaaaaggcaaacgggttaataatgatttgggtaaatacttcattactaaaggagcatcgattccatattat

SEQ ID NO: 68 - protein, 173 aa, Lactobacillus acidophilus
MMQMNRKIIMASVAAIIGIGSIIGINTATSGENVVYASVYKTTGNNKVKVVKSTSFVNNRGVKQAISAEKGGSYTVYAVNYIDGVAYVSVHKSNRYWLPVSAVKGKIFYQRGRDNATYMISAGNNSDTVSLQTNNKGNVTLKSNAYVYNLKGKRVNNDLGKYFITKGASIPYY

SEQ ID NO: 69 - DNA, 876 bp, Lactobacillus acidophilus
  misc_feature (0)...(0): ORF 514 - surface layer protein
  CDS (1)...(876)
ttgaatggacaagtattccaagttgctgttggttcaaacttcaatccattgaactttactaacagtaacggtgaaaacatcattgtttctgctcaacaaagtaagaacaacactacttttgcaagcattgaagcaacttcaaacccagttaatacttcagaagcaggccgttactacaatgtaactttaactgcaactggtaacactggcaagaagactacagctacttatactgttttaattacttcaagccaaaagcaaactttatacggtaatggtgaaagtacgatttctacttacagtatttacggtaacaacgttttaagtaactcaaccacttttaaagatggtgatcaagtttatgtttcagatcaaactaagactgttggtggagtttcatactcacaagtttcacctaaatcaaagaatgatgctaactcaagtaacatttgggtaaagacctcagcacttgtgaagccagcaggtgacaccaatgttaagacttacccagtaatggttgactcaagagcttacgacaagaacggtaactacttaggtcacatgtactatgcatatgacaacattgacatcgttccaactgttgtaaccatcaacggcaagacttactacaaggttgctaacaaggatgaatacgttcgtgtaactaacattactggtaaccaacgtaccttgaagcacaacgcttacatttactggtcatcataccgtcgtactccaggtactggtaagatgtatagaggtcaaactgtaactacttacggtccacaaatgaaattcaagaacggtaagaagtactacagaattgaaggctgcagaaataacaacaagcgttacatcaaggctgtaaacttctat

SEQ ID NO: 70 - protein, 292 aa, Lactobacillus acidophilus
MNGQVFQVAVGSNFNPLNFTNSNGENIIVSAQQSKNNTTFASIEATSNPVNTSEAGRYYNVTLTATGNTGKKTTATYTVLITSSQKQTLYGNGESTISTYSIYGNNVLSNSTTFKDGDQVYVSDQTKTVGGVSYSQVSPKSKNDANSSNIWVKTSALVKPAGDTNVKTYPVMVDSRAYDKNGNYLGHMYYAYDNIDIVPTVVTINGKTYYKVANKDEYVRVTNITGNQRTLKHNAYIYWSSYRRTPGTGKMYRGQTVTTYGPQMKFKNGKKYYRIEGCRNNNKRYIKAVNFY

SEQ ID NO: 71 - DNA, 648 bp, Lactobacillus acidophilus
  misc_feature (0)...(0): ORF 1455 - surface layer protein
  CDS (1)...(648)
atggtctggcgtggtcataaaaaagcatcgttttataatattggtggtaatcgttatctcttaggctataatgttgcttcgcttaatgataaaggaacgttgagtatatatcgtgattcgtatatttatgataagactggtaaaagagttgaaaaaaatactgtacttagaaaaggcacagcaattaattatgtagataaattaaacgaaaaaatcgaaacagaaaagaatttacctaagttttattactataatatggcgattcaacgtacgcatgaaggtatgttatgggtaaaatatagtgtattgtcggtaaaatatcatattattaatggaaaagaatattataaaattgcaaataataaatatattagagcaactaatatcggttacataaacggtaggcagttatttacaactgaagctacagttacaatgggaaaagcaacgactaaagatggaaaatactatgctagaaatatgaatgggaaaattactaaaactattttgccttataagccgggacaaaaagtggttgtagataggtctttccaacattcttctaaatcgttttggagaataaagggaacaaattattatatttttggaccagacattaaaaagttcccaatacaggcattacgccgg

SEQ ID NO: 72 - protein, 216 aa, Lactobacillus acidophilus
MVWRGHKKASFYNIGGNRYLLGYNVASLNDKGTLSIYRDSYIYDKTGKRVEKNTVLRKGTAINYVDKLNEKIETEKNLPKFYYYNMAIQRTHEGMLWVKYSVLSVKYHIINGKEYYKIANNKYIRATNIGYINGRQLFTTEATVTMGKATTKDGKYYARNMNGKITKTILPYKPGQKVVVDRSFQHSSKSFWRIKGTNYYIFGPDIKKFPIQALRR

SEQ ID NO: 73 - DNA, 1077 bp, Lactobacillus acidophilus
  misc_feature (0)...(0): ORF 1029 - surface layer protein
  CDS (1)...(1077)
atgcaaagtaatgatgctaatgtagttcaagctgccactagtaataagaaaaatacgattaagttaattagtactaacaataatatcaaaattcctgtgtatgaccgtcaaggtaagcaaattaatggatttacagttgaatcaggtgccaatgtaactgttatcggcaaaccaattattgttcaacaaaagtatagaaaagatgtctttgaaggtataaaaattaatggtaaaacttatgcatccctaggcgatggaggttatattccaataaatgctacaggtgttattacatctaaaggaatgaaaattacacgtgatactgccgtttataacaaaaacggtaaaaaattgagtacatatcgcggacacacggctactttaaaaaaggattcaatcgtaaaatacggtggcgcaactacctatacaataccggtatcttacttcaacattggtaatggtcgttatgtaagagccagctatgttcaagaatataatggtcaaacagttttaactttgaattataatacttttgtttataacaaaaagggtaaacgtatcaactacgatggccaacgtaaattaatgaacggtggcgtagtaactactaatagtaaaattagagaagctaagtcttcagatcaaaactacttctatagtagtgctaattatactgataaaaataaattagcttttacgactacaaaaattaagggccaagattatctttcaattggtaaaggtgaatatattaaaattgctaatgtaaaaacagctaatggaatgattttatttactaaaggtcctatcactattactttgcctagtgacactactatttacagctctaatttcaaggaaacgaagaaacaaattgctgctggtaagaaagtaattttggataaaactgaaattgataatagtttaagtgatccacaattatatttcagaattaagggtactaatgaattgatctactggggcgatttgggagaatatcctggtgttgatcacactgctgtttacgatccaaattattatagtatttattcattcccacttagacaatttatggaa

SEQ ID NO: 74 - protein, 359 aa, Lactobacillus acidophilus
MQSNDANVVQAATSNKKNTIKLISTNNNIKIPVYDRQGKQINGFTVESGANVTVIGKPIIVQQKYRKDVFEGIKINGKTYASLGDGGYIPINATGVITSKGMKITRDTAVYNKNGKKLSTYRGHTATLKKDSIVKYGGATTYTIPVSYFNIGNGRYVRASYVQEYNGQTVLTLNYNTFVYNKKGKRINYDGQRKLMNGGVVTTNSKIREAKSSDQNYFYSSANYTDKNKLAFTTTKIKGQDYLSIGKGEYIKIANVKTANGMILFTKGPITITLPSDTTIYSSNFKETKKQIAAGKKVILDKTEIDNSLSDPQLYFRIKGTNELIYWGDLGEYPGVDHTAVYDPNYYSIYSFPLRQFME

SEQ ID NO: 75 - DNA, 5028 bp, Lactobacillus acidophilus
  misc_feature (0)...(0): ORF 1633 - surface protein
  CDS (1)...(5028)
atgggaacgggtcaaagtaaatctgttaaggccgattctgtgcaagatgacatgattacgcaaacagatgaagatgaagcattatcggatgaagtgaaaatagatactacggatacttcaaccgaagaagtaagtaatccagctacagacacttcaaccgaagaagtgaatggtccgtcttcggatagtttaacggtagtggatccgacaatggaaacacagtctcctgttgaagatactataacaacagaaccggataattcagcagttaatgatacaaaccattcaactgccgatacttcggaagttgaaactaatacgtctactactgataacgtagcagctgaaacgactaatacagctgcaagtactacaacaaatgcggatgattcagttaatgctgcagacacaagcacaatgactgtggttaagacaactgaagaaaaatctgatgaaaatgatcagactaaagaagccgtagataagttaactgttggtgcaactaaggccaaagctttggccgctgcagcagaaggacagactgtttcggtaacagattatcagacatttttagatgctttacgcaataaagatgtaagcactattgattttgcaaatgatattgatttcagtgatgcgttatttaaacgtggacttattaattacaaaaatgtgattttgaatgaatcaactgatgaagatattgctcgtgcagtgacgattaatggtaacggtaataaattaattatgagtgaccgttacattcaatttactagtaggaatcaaaagactgatggtaaaaattgggatattgaattaaaagatttaaccctacaaactaccagtggctatggtcccttctggtttgataatactgctaagcaagctgctggcaataccattacctttaatggggttaacaccacagcagattcacgtgaaattatgtggtataagagtggtgccatttatagttcgacagctaatgtagtctttaaaggaaataatgtaattaacagtactcttaagggggatactgctgcaatttacgcttacagcgtcaaagcagaagaaggtagcactactacatttaatgtaattgatgaatcacctgccaattctggctatgatcgagcagtaattgtgattcctgataataaaaattctggaaatgttacggttgctaaaggtgctactttaaatattaatgcggataataaagtaactgtggaaggaatggacggctcgaattcctatggtacgatgggtatccgttttaaaggctgggcacaaaatgcagatatagatacagctgcgactagtgtggttcaggtattaggtaacttgaatatgaatatgggatcaggcggttctactgccattcttgggtcatatgttgatgttcaaaacgttggaaatgttaatattgaaacggctcaagatggtaataatggtaatactggtactttagaagtagaacataatggtactcactttggtgtaattacaggtggattagctggtagtgataactatgcaggtataagaattgctgatggtggtactttgaaaattgttcgttcggtagataatgaaaacggcaataaatctacacaaccgttaatttcatatggggatatcactacttcaaacggtaaaacttttactattgatgttaaaccaggcggtacgcttgatttacaagataatgcacagaaccctaatgaatgggaacctaatactggtacgcctttagcaggattaattacaatgtggggtactagtggtacaaacattgttaaaattaatgatcctaagtatgtgaacttccaacgtactggcagtcaaccaggttcaatgttacggttggaaggtactactaatagtgtttctattaatggcgatggtaatgctgtaactcctgttgcacaatgggatgtaggcaatactggtaatgaaccatcatactactggtatattttgaatgaaactaatcagaataattggggaacaaatgcaaatgggtttactcaaaagggtgaaactaaaccagttaataaagatggtgaagctaaattccttaattccaacggtagtgttgaactagctcctaatcaatcaggttctacagcatcaagttataacaatgggactataaccgaatcatctgatcaaactatgtacctaaaccagttcttaaataactttaactggtggactccacagagaatcgctatgggtagcatgttaaaggatgtagctaccaatgcccaagaatataaacctgaagtaaaagaaattactgcaggtgctaatgatgtcctcaaagacgtcgatccattagaaggtattacggggttaactgatagcaatggtaacccggttgaaaatggattgagttatatccaaggtgtgacttggctagattcaagtactgatgcggagaactggaagaaattaatgagcaatgagaaagttccaacgaatccgaccggtaaattaggagatttagcaccggatgaaaaatttgcttgggctaaggtaacttacaaagatgattcaattgatttcgttaagattccgttgaatgtagttactgatccaatgaaggataattacacgccagcatatgaagatgtgagtgtggaacaaggaaaagacaatagtgcacaacctgcaaatccgacatttactgataagaatggtgacacattagataccattccagaaggaactacattcgctcctaccgctgatactccaacttgggtagaaattgatccaacaacaggtcaattaattgctaagccaccggtagatgtagaagctaaagattatgaaattccggtgacagtaacttaccaagatggaacaaccgatacagttttggcaaaagtaactgtaacaccaacagaaactaaagaagacagtaataaatacacacctgtttatagtgaaggcgttggagaagctggtaaagacttcaacgtagatagtccaacatttacagatgaagacggaaacaaggttactactccaccagttactgtctttgaaaaaggtgaaggagctccagattgggttaaagtagatccgaacaccggtgcattaactggtactgtaccagaaggaaccactggagatgttgtaattccggttaaagtaacataccaagacggttcaagtgaggtagtgaatgcaacagttaaagttacagaaccaacgacaccaggtcaaacagctgatgatcataatccaaaatatgaagatgtcgatgttaaaccaggtgagacgaataaggtaactccaaccaataccgataaagatggcaatctagcgaatatcccagacggaactaagtttgagaaagatccggatgctccaagttgggtagaggtagatccgaataccggtgaattgactgtagcgccaccggaaggcacgccatcgggtgaacatgaaattaaagtaaaggtaacgtacccagacggttcaacagatgaagtaccggtaacggtaaaagtaagtgaaccaacgacaccaggtcaaacggctgatgatcataatccaaaatatgaagatgtcgatgttaaaccaggtgagacgaataaggtaactccaaccaataccgataaagatggcaatccagcgaatatcccagacggaactaagtttgagaaagatccggatgctccaagttgggtagaggtagatccgaataccggtgaattgactgtagcgccaccggaaggcacgccatcgggtggacatgaaattaaagtaaaggtaacgtacccagacggttcaacggatgaagtaccggtaacggtaaaagtaagcgacccaacgacaccgggtcaaacagatgccgataagtacacgccagaggcaaaggatattaccgttactccaggcccaactccagatccagcagaaggcatcggtaataaggacacattaccatcaggtactaagtatgagtggaaagatccagttgatacaactactccgggtgacaagacaggcacaattgtagtaagttacccagatggatcaacagacgagattcaagtaacagtaaaggttacggacccaacgacgccgggtcaaacagatgccgataagtacacgccggaggcaaaggatattaccgttaccctaggccaaaccccagatccagcagaaggcatcggtaataaggacacattaccatcaggtactaagtatgagtggaaagatccagttgatacaactactccgggtgacaagacaggcacaattgtagtaagttacccagatggatcaacagacgagattcaagtaacagtaaaggttgcagaaccaacgacaccaggtccaacagatgctgacaagcatactcctgaagctaaagatgtaacagtagttcaaggccaaaccccagatccagcggaaggcatcggcaataaggatacattaccaccaggtactaggtatgcatggaaagatccagttgatacaactactccgggtgacaagacaggcacaattgtagtaacctacccagatggatcaacagacgaagtctctgtaacgttacatgttactccttctgaaagtggcacaacagatacatcaacgacgccacctaccgatacttcaggtagtgacactgacactacttcaaaaggtgaaacgccagctgatacaccaccaacggatacagcttctgattcgacagataccactccaaaagatgaaaatactgataatacaggtggtactcataaatccaccaatactgactctagtcaaagtggtgcgacaggcaatacttctagtggtgcgaatgcaagtagtaataccgaaattcatgctagtgatgtaactactgaccaatacacaacggtaaacgacaatactgcagatatgaatactcttccacaaacaggcgaaacagaccgcaacgttggagtatggggtatgattattgcagcagtaggtagtctatttggtttaggccacggtaagaaacgtagaaaggatgaa

SEQ ID NO: 76 - protein, 1676 aa, Lactobacillus acidophilus
MGTGQSKSVKADSVQDDMITQTDEDEALSDEVKIDTTDTSTEEVSNPATDTSTEEVNGPSSDSLTVVDPTMETQSPVEDTITTEPDNSAVNDTNHSTADTSEVETNTSTTDNVAAETTNTAASTTTNADDSVNAADTSTMTVVKTTEEKSDENDQTKEAVDKLTVGATKAKALAAAAEGQTVSVTDYQTFLDALRNKDVSTIDFANDIDFSDALFKRGLINYKNVILNESTDEDIARAVTINGNGNKLIMSDRYIQFTSRNQKTDGKNWDIELKDLTLQTTSGYGPFWFDNTAKQAAGNTITFNGVNTTADSREIMWYKSGAIYSSTANVVFKGNNVINSTLKGDTAAIYAYSVKAEEGSTTTFNVIDESPANSGYDRAVIVIPDNKNSGNVTVAKGATLNINADNKVTVEGMDGSNSYGTMGIRFKGWAQNADIDTAATSVVQVLGNLNMNMGSGGSTAILGSYVDVQNVGNVNIETAQDGNNGNTGTLEVEHNGTHFGVITGGLAGSDNYAGIRIADGGTLKIVRSVDNENGNKSTQPLISYGDITTSNGKTFTIDVKPGGTLDLQDNAQNPNEWEPNTGTPLAGLITMWGTSGTNIVKINDPKYVNFQRTGSQPGSMLRLEGTTNSVSINGDGNAVTPVAQWDVGNTGNEPSYYWYILNETNQNNWGTNANGFTQKGETKPVNKDGEAKFLNSNGSVELAPNQSGSTASSYNNGTITESSDQTMYLNQFLNNFNWWTPQRIAMGSMLKDVATNAQEYKPEVKEITAGANDVLKDVDPLEGITGLTDSNGNPVENGLSYIQGVTWLDSSTDAENWKKLMSNEKVPTNPTGKLGDLAPDEKFAWAKVTYKDDSIDFVKIPLNVVTDPMKDNYTPAYEDVSVEQGKDNSAQPANPTFTDKNGDTLDTIPEGTTFAPTADTPTWVEIDPTTGQLIAKPPVDVEAKDYEIPVTVTYQDGTTDTVLAKVTVTPTETKEDSNKYTPVYSEGVGEAGKDFNVDSPTFTDEDGNKVTTPPVTVFEKGEGAPDWVKVDPNTGALTGTVPEGTTGDVVIPVKVTYQDGSSEVVNATVKVTEPTTPGQTADDHNPKYEDVDVKPGETNKVTPTNTDKDGNLANIPDGTKFEKDPDAPSWVEVDPNTGELTVAPPEGTPSGEHEIKVKVTYPDGSTDEVPVTVKVSEPTTPGQTADDHNPKYEDVDVKPGETNKVTPTNTDKDGNPANIPDGTKFEKDPDAPSWVEVDPNTGELTVAPPEGTPSGGHEIKVKVTYPDGSTDEVPVTVKVSDPTTPGQTDADKYTPEAKDITVTPGPTPDPAEGIGNKDTLPSGTKYEWKDPVDTTTPGDKTGTIVVSYPDGSTDEIQVTVKVTDPTTPGQTDADKYTPEAKDITVTLGQTPDPAEGIGNKDTLPSGTKYEWKDPVDTTTPGDKTGTIVVSYPDGSTDEIQVTVKVAEPTTPGPTDADKHTPEAKDVTVVQGQTPDPAEGIGNKDTLPPGTRYAWKDPVDTTTPGDKTGTIVVTYPDGSTDEVSVTLHVTPSESGTTDTSTTPPTDTSGSDTDTTSKGETPADTPPTDTASDSTDTTPKDENTDNTGGTHKSTNTDSSQSGATGNTSSGANASSNTEIHASDVTTDQYTTVNDNTADMNTLPQTGETDRNVGVWGMIIAAVGSLFGLGHGKKRRKDE

SEQ ID NO: 77 - DNA, 5772 bp, Lactobacillus acidophilus
  misc_feature (0)...(0): ORF 1634 - surface protein
  CDS (1)...(5772)
atgttatccaagaataatttcaaagaaagattaagaaagatggaaccgagaaaagaacggttttccattcgtaagttttctattggagcagcttcagttttgattggcttcagctttatgagcatggctggaaatcaaaaagttcaagctgctactgaagaggagcctgtagtagcgactaaaaatactgagcaacaatcaaagactgatggtactcaaagtgctgaagaacaatcaagtgcagatgcaggtaatgctcaaaataataaatcagctaaggcaaatgcaactacaccaagtaatcaaaatgctactgatagcaaacttactcaatcttctgctcaagatttatcaaaggataatgttaattcagactcaaagaatgcatcagattctacaagtgaagtaaagcaaaacaatcaagcaattcaacccgaaacttctaagccctcaagagaagttgagaataatgagactgctaagaatgcttcagctagtcaaacgactaatacattaaatgttaataaagcatcagaaactcaagctaaatcaggtagtgagtcagttacctctcctaataaaggtctagtttctgagaataaagcaaaagtagaagttaagagtagtacacaacctaaagctgcaatgctatcattggttcaagagtcaaatcctgctactcaaactgaaacagtaacagactactcaacgtttcttaatgctttgcgtaatgctaatactggcactattaatttacaaaatgatattgactttagtaatgcaaatttaaagcatggtcctaataatggattatctggaaagtatgaacgccttaataatactggaattgcacgtgctataactattaatggtaacggccacgagctaaagatgggagaccgttacattgaatttaccagtgctaatcaaaaaaatactaatagtaattgggatattcaattaaaggatcttaccttacaaactaccagtggatatggaccattctggtttgataatacagcagatgaagcggctaaaaatactattacttttaacggggtaactactactactgattcacatgaaattatgtggtataacggcggtggtgcctcaactactcatgttaaattcgaaggcaataatactatcaacagtacgcttaatggtaatactgcagccatctatgcttatagtgttgaagcagtaaatggaaatacaacctttaacgtaattgatagctcaccagataatgcaggtgctaatagatcagcaattttgatttcaattgatgcagctcatgcgggtaaagtcatcgttgataaaggtgctacattaactattaatggagataatcaagttaatgttccgaaaatgaatagtgctgattcttatggtacgatgggaattcgtttccaaaactgggctaaaacagatatcgataaagctaagaccagtgttgttcaagttaacggtaatttaaacttgaatatgggtaaaggtggttcaaccgctattttaggttcttatgtcgatgtacaaccagacggtaatgttactattaacacgcaacaaaatggtactagcactgttgctggtgacttggctctaggtcatagaggtactcactttggtgtaattgctgggggtatcgaagttagtgatgattatgctggcttgagaatcgctaatggtggtagtttaaagattgttcgtccaaccgatgtaaactctactcagcccttaatttcatatggtgatgcaggttcttctggtggtaaaacatttacagtaaatgttgaaaatggtggtactcttgatttacaagatggtgctactgatccacaaacttggagctttagtaatactagtagcacgggtaatactaatatgccatgggctggtttgattactatgtggggaaccagtggtacaaatactattaaaattaataatcctaagtatattaatttgcaacgtaccggcaaccaaactggatcattaatgcgccttgaaggtactacaaataatgtttcaattaatggcgatattaataatgttattaccccattagctcaatgggatgaaggtgcaaagaataatccttcatactactggtatattgagaatgaagctaaccagaataactggggtaattatgcaaatcgctttgtacaaagtggaaagaatcctcagcccgctgcaaatgccggagttactacatttatgcattcaagcggtagtgtacagatggctcctaaccaggcaggaactaattcatccaagtttagcaatggagaagttgcccaaactctaaatgaagctataaattatcaagctccatatttgaatcaattcttgaatcactttagttggtgggcaccacaaagaattgccatgggaagcggcttagaggatgtagtaaaaccaactgatgctgaaaagtatcaaccagaagttaaaactattaatggtaatactaaacaaactttaaaggacttaactgctaaagatggtattaaaggcttgctttctagtgatggtaccgagacaactgatctttcttctgttaagagcgtaagctggtatgatacagctactgatgccactggttggaagagcttaatgggagatgaaacagagccaactaatccaactggtgatttaaagaccactgataaatcagcttgggcaaaagtaacttatcaagatggatcgattgactttgcaaatatcccattgaatattactgaaccaacagcaaatctttacactccatcatataagccagtaactgttgaacaaggccaatctgctactgatgatccagcatttactgatcaagctggtaaggatgctactgctccaactggaactacatttactacaggtactgatacgccagattgggcaaccattaattcatcaactggtactgtaactgttaaaccaggtgccaatgtaactgtaggtgcttacaatgttccagtaactgtaacttacccagacaagagtactgatgagactactgttccagtaattgtcactaaggctggccaaacagtaacttggggtgataagggtgcagttgtaactagcgttgatacttctaaacttaacgctcatgaaactactgaaaattcacaagttctttctgctggtggcgttgtaactgcagaaggttacgaattaacagatggtaaactttcaactacagctactccaattacgattgacccatcaactgtaagttggactacaacgccagatactaacgttgataccgcaactgcaactggtaagaaaattgaaaacagcactattaagattgacttcactaacaatgatgcagctaagaatagcctaggctcaaagaatggtgttgtaactactaatccatttaccattgatgctaaaggtgctggtgctaaggctgtaactgctccagttgatattaaacttggctcagatttaaatagtgaacaatttgatcaattagtagataacaacatcccaattgatgagattgcatctaccacttgggcaaccatgcctaatgaaaaaggtcaaggcggagtaatcaagattacctttactgataaggatgctaatggtaatccaacttacttgaacattaatattccagcaagttcaatcaaggtaactactgatgcagaaaccaataccccacaaggtcaaaacgtttcaactaaggtcggcgaagttccagatccagcagaaggcatcaggaacaagagcgacttaccagatgaaactaagtacacttggcaagacactccagataccactaaaccaggtaagaaaccagcagttgttgtcgtaacttatccagatggctcaaaagatacagtttcaactaatgtaattgttgatgctaagccagagattaagacgattactacaactgttggtggagatccagttgctactgaaggtattgctaacttgaataatggtggtaatactccagttgatggttatccaacaagtgcaacttggactactaaaccagatacttcaaagtcaggtacaactactggcactgcgactgttacatatccagatggtactaaggaaactgtaactattccggtaaccgtgaataagagtagtcaagtaacaatgacttatgacttctactcaacggttactatcgataacccagatggcacatcaacaactgagccaaggcagcacataagttttacttatctgggtattccaactgatgcagatgtaaatgttgaatttaagaatgtagctattccaagctttgacggttatactccagaagtaagtttgactacacctagtgctgaaggtacaccaatggctactcttgaaaagggagttgatggcaagtggacattgaagttaccaaagccagaattatcttatccatactacaattacactattagctacaagaagtctggttcagaaacaccaaccgatgcagacaagtatactccagaaggccaagatgtgaacaccaagaccggcgttgtaccagatccagcagaaggtatcaagaacaagagtgacttaccagagggcactaagtatacttggaaagacaccccagatgtaactacttcaggtaacaagccggccacagttgtagtaacttatccagatgattcaaaggacgaagttccagtaactatccacgtaacgaacccaacaacaccaaccgatgcagacaagtatactccagaaggccaagatgtgaacaccaagaccggcgttgtaccagatccagcagaaggtatcaagaacaaaggcgatttaccagacggtactaagtacacttggcaagacaccccagatgtaactacttcaggtgacaagccagtaacagttgttgtaacttacccagacggctcaaaggatgaagtctcagtaactatccacgtaacgaacccaacaacaccaaccactccaactactccaactactccaactgatgccgataagtatactccagaaggtcaagatgtgaacaccaagaccggcgttgtaccagatccagcagaaggcatcaagaacaagggtgacttaccaaatggtacaacttatacttggaaagctaccccagatgtaactactccaggtgacaagccagtaacagttgttgtaacttacccagacggctcaaaagatgaagttccaattacaattcacgtgattgacaatactccaaatcaaccatcatctaaggatgacaacaatactcctaaaaagagtgatgctgataagaatactccaaagggtaaagacattactgtaaaacaaggtgaaacaccaaatccagccgacggcattaagaacaaaggtgatttaccaagtggtaccaagtatacttggaagaatactccggatacttcaactccaggtagaagaactgcaacaatagttgtaacttacccagatggttcacaagatgaggtaacaatcaacataaatgttatggctgaaaatagtgctaataataacagtaatactaatgttcatgatgatgttgccaagcaaaataatgcaccacaagctcaagatatgaccgtgccttcaatcaatagtgctactaatggcactaacgtaaaggcacaaacaggtgcacaagtatctcataaaaattcacttccacaaactggatcaaatgataataaagctggtatctttggtttagctatcgcaactgtaggcagtttgtttggacttgcctttggtaaaaaacgtaaggaagatgaa

SEQ ID NO: 78 - protein, 1924 aa, Lactobacillus acidophilus
MLSKNNFKERLRKMEPRKERFSIRKFSIGAASVLIGFSFMSMAGNQKVQAATEEEPVVATKNTEQQSKTDGTQSAEEQSSADAGNAQNNKSAKANATTPSNQNATDSKLTQSSAQDLSKDNVNSDSKNASDSTSEVKQNNQAIQPETSKPSREVENNETAKNASASQTTNTLNVNKASETQAKSGSESVTSPNKGLVSENKAKVEVKSSTQPKAAMLSLVQESNPATQTETVTDYSTFLNALRNANTGTINLQNDIDFSNANLKHGPNNGLSGKYERLNNTGIARAITINGNGHELKMGDRYIEFTSANQKNTNSNWDIQLKDLTLQTTSGYGPFWFDNTADEAAKNTITFNGVTTTTDSHEIMWYNGGGASTTHVKFEGNNTINSTLNGNTAAIYAYSVEAVNGNTTFNVIDSSPDNAGANRSAILISIDAAHAGKVIVDKGATLTINGDNQVNVPKMNSADSYGTMGIRFQNWAKTDIDKAKTSVVQVNGNLNLNMGKGGSTAILGSYVDVQPDGNVTINTQQNGTSTVAGDLALGHRGTHFGVIAGGIEVSDDYAGLRIANGGSLKIVRPTDVNSTQPLISYGDAGSSGGKTFTVNVENGGTLDLQDGATDPQTWSFSNTSSTGNTNMPWAGLITMWGTSGTNTIKINNPKYINLQRTGNQTGSLMRLEGTTNNVSINGDINNVITPLAQWDEGAKNNPSYYWYIENEANQNNWGNYANRFVQSGKNPQPAANAGVTTFMHSSGSVQMAPNQAGTNSSKFSNGEVAQTLNEAINYQAPYLNQFLNHFSWWAPQRIAMGSGLEDVVKPTDAEKYQPEVKTINGNTKQTLKDLTAKDGIKGLLSSDGTETTDLSSVKSVSWYDTATDATGWKSLMGDETEPTNPTGDLKTTDKSAWAKVTYQDGSIDFANIPLNITEPTANLYTPSYKPVTVEQGQSATDDPAFTDQAGKDATAPTGTTFTTGTDTPDWATINSSTGTVTVKPGANVTVGAYNVPVTVTYPDKSTDETTVPVIVTKAGQTVTWGDKGAVVTSVDTSKLNAHETTENSQVLSAGGVVTAEGYELTDGKLSTTATPITIDPSTVSWTTTPDTNVDTATATGKKIENSTIKIDFTNNDAAKNSLGSKNGVVTTNPFTIDAKGAGAKAVTAPVDIKLGSDLNSEQFDQLVDNNIPIDEIASTTWATMPNEKGQGGVIKITFTDKDANGNPTYLNINIPASSIKVTTDAETNTPQGQNVSTKVGEVPDPAEGIRNKSDLPDETKYTWQDTPDTTKPGKKPAVVVVTYPDGSKDTVSTNVIVDAKPEIKTITTTVGGDPVATEGIANLNNGGNTPVDGYPTSATWTTKPDTSKSGTTTGTATVTYPDGTKETVTIPVTVNKSSQVTMTYDFYSTVTIDNPDGTSTTEPRQHISFTYLGIPTDADVNVEFKNVAIPSFDGYTPEVSLTTPSAEGTPMATLEKGVDGKWTLKLPKPELSYPYYNYTISYKKSGSETPTDADKYTPEGQDVNTKTGVVPDPAEGIKNKSDLPEGTKYTWKDTPDVTTSGNKPATVVVTYPDDSKDEVPVTIHVTNPTTPTDADKYTPEGQDVNTKTGVVPDPAEGIKNKGDLPDGTKYTWQDTPDVTTSGDKPVTVVVTYPDGSKDEVSVTIHVTNPTTPTTPTTPTTPTDADKYTPEGQDVNTKTGVVPDPAEGIKNKGDLPNGTTYTWKATPDVTTPGDKPVTVVVTYPDGSKDEVPITIHVIDNTPNQPSSKDDNNTPKKSDADKNTPKGKDITVKQGETPNPADGIKNKGDLPSGTKYTWKNTPDTSTPGRRTATIVVTYPDGSQDEVTININVMAENSANNNSNTNVHDDVAKQNNAPQAQDMTVPSINSATNGTNVKAQTGAQVSHKNSLPQTGSNDNKAGIFGLAIATVGSLFGLAFGKKRKEDE

SEQ ID NO: 79 - DNA, 1059 bp, Lactobacillus acidophilus
  misc_feature (0)...(0): ORF 1568 - surface protein
  CDS (1)...(1059)
ttgttttcggagatttttattttaattttagcacttatgaaagtgttaaaatcaacttgtaggtttcattataaggagaatattatgaagaataaaaaattagtagctattgcagcgacacttttaatcagcgcttctccagtagttgcactgattaatcaaccaatccatccagttcaagccgttaatcaaacactaaaagataaaatcaaattaaaaaagacttttaacaacactattcaagttttcaacagcaaaggtaacgcttctacaactaccaagactattaatggtaaaaagatgaccgaagcctcaacagttaaagctggtcaaacttttaaatattatggcagtccagtactgatccaaggtaaaaagataactgatagtaccaataagaattatcactacgcaaccgcttcttatatcaatattggtaaaaaacgttatattaaatcaataaatgttagttcaatggatggacaaaatgtcttagtcttaagtgctaattcacgtatctatgataaaaatggacatcgtactacctttaacgggcttacattaattccaaaatatatgttacttaagacacctgataaaacacatgtgacaaccaaaaatgatatgttttactatttttcaaatcttaatggttctaaaaaaagaagcttaaatacaacaactattaatggcaaattgtattattcattaggtaaggatgcttatattagagcttcaaatgttggctacatcaatggtaatactgtatatcaagcctctggtacaactactgccactattttgaataagattcacgttttggataataaattaaaaacaactaacaaggccttaaaagttggtaaaaaggttaaggttgatgcaacaaaagttactggacaaggcgatagtgctgccctttactttagaattgctggtactaaaggtaacaatgctcaatatatctattggggcgactattccgaatatggtatggatcaggagagtactaccgatgaatttcaaggtaacttcaacttagcaaatcatttagcaaat

SEQ ID NO: 80 - protein, 353 aa, Lactobacillus acidophilus
MFSEIFILILALMKVLKSTCRFHYKENIMKNKKLVAIAATLLISASPVVALINQPIHPVQAVNQTLKDKIKLKKTFNNTIQVFNSKGNASTTTKTINGKKMTEASTVKAGQTFKYYGSPVLIQGKKITDSTNKNYHYATASYINIGKKRYIKSINVSSMDGQNVLVLSANSRIYDKNGHRTTFNGLTLIPKYMLLKTPDKTHVTTKNDMFYYFSNLNGSKKRSLNTTTINGKLYYSLGKDAYIRASNVGYINGNTVYQASGTTTATILNKIHVLDNKLKTTNKALKVGKKVKVDATKVTGQGDSAALYFRIAGTKGNNAQYIYWGDYSEYGMDQESTTDEFQGNFNLANHLAN

SEQ ID NO: 81 - DNA, 1092 bp, Lactobacillus acidophilus
  misc_feature (0)...(0): ORF 177 - autolysin; amidase
  CDS (1)...(1092)
gtgaagttaaggaagaagttaataaccttaattgcggcaataagtttaacaggtgttgcgacaaatacaggcgttaacattgttcaagccgactcaattaatgtacaagctaaaaaatatcaatatagcggtgttacctatttatataagatgctcaagcttgaagggattaagtataataaattcccaggtgttgaatataaaactggtaaaccggaaggaattgtaattcacgaaactgatgatcctggtgcaacagcccacgatgaagcaatttattttaatcgtgaatggcctaaagtaaaggcttatgttcatgcctttgttgatgatgaccatgtcatccagatgagatcacctgagatgggtacttggggcgctggacctaatgctaacgatcgtttcattcagattgagctttgtgaagagaacactcgtgatgcttttattaaatcaattaacaatgatgcgatttatgtagctaagttgcttcatcgctatgatctcaagcctgataatgcttgtgatgatggtgaaggaacgatttggtcacaccatgccgtaagtacttatcttggaggaaccgatcacgttgatcctgatggttacttcgaaaagtggggctacagtatggatcaattctttgacttgattcagtattactatgatttgcaagctaaggatactgatgctaaggaaaaggatccagctaagagtaagaaagatgtcgaagcaattcaaggtgcagtaactttaggtcatgatgcttatatttatgatgctaaaggcaagaacaccaagaaacttaagaaggctggtggtcctgttgttgtcatgggttacaaggctatgaataataagaagtactaccaaattggtaagaatcaatatgtagttgcctctaacattgacgctacagatagagtagttaagaaaaatacttacttacgaactaatactgggcgaatcgaaccggaaaacaaagtcaagaaggggagccgagtattaacttatggtagtcgtgtcacaattaaaggccaaaagtactatgcacttaacgccacacaatttattttggcaagtgatatagaa

SEQ ID NO: 82 - protein, 364 aa, Lactobacillus acidophilus
MKLRKKLITLIAAISLTGVATNTGVNIVQADSINVQAKKYQYSGVTYLYKMLKLEGIKYNKFPGVEYKTGKPEGIVIHETDDPGATAHDEAIYFNREWPKVKAYVHAFVDDDHVIQMRSPEMGTWGAGPNANDRFIQIELCEENTRDAFIKSINNDAIYVAKLLHRYDLKPDNACDDGEGTIWSHHAVSTYLGGTDHVDPDGYFEKWGYSMDQFFDLIQYYYDLQAKDTDAKEKDPAKSKKDVEAIQGAVTLGHDAYIYDAKGKNTKKLKKAGGPVVVMGYKAMNNKKYYQIGKNQYVVASNIDATDRVVKKNTYLRTNTGRIEPENKVKKGSRVLTYGSRVTIKGQKYYALNATQFILASDIE

SEQ ID NO: 83 - DNA, 1002 bp, Lactobacillus acidophilus
  misc_feature (0)...(0): ORF 798 - rod shape-det. prot. MreB
  CDS (1)...(1002)
gtgtttggattaggtacaaaaaatattggtatcgatttaggtacagccaatacactcgtttatatggaaggtaaaggtattgttttaagagaaccttccgtagtagcaaagaacacacaaacaggtgaagtaattgcagtgggttcagaagccaaagaaatgattggtagaacaccaggtactatcgtagctatccgtcctatgaaagacggtgtaattgctgattacgatacgactgctgctatgcttaaatactttatggaaaagactgttggtaattctaagccttcagtaatggtatgtgttccttcaggtgttactgaagttgaaaagcgtgctgttattgatgcagctagagtagctggtgcacgtgaagcatttgtgattgaagaaccatttgctgcagctattggtgcaggacttccagttatggatcctactggttcaatggttgttgatattggtggtggtactactgatgttgctacaatttcattaggtggtatcgtgtcatcaacttcaattcgtcaagcaggtgacaagtttaataattcaatcatcaattacattcactcaaactttaacttattaattggtgaaagaactgctgaagatattaagattcaaattggttcagcttctattgaaaaggccaaagatatcgaatcaatgaatatccgtggtcgtgatttagttactggtttaccaaagtcagttgatgttgatgcagttgatattgctaaggcaattcaagatgttgttcaagatattattgttgcaatcaaagagactttggaacaaacttcacctgaaattgctgccgatgttatcgatcatggtatcgtattaactggtggtggagctcttcttaagaacttgccagaagttatttctgaagcaaccaaggttcctgtatttattgctcaagatccacttgattgtgtagcaattggtactggtgaatcacttaaaaatattgaagtaatgcgtagaagtcgcaaa

SEQ ID NO: 84 - protein, 334 aa, Lactobacillus acidophilus
MFGLGTKNIGIDLGTANTLVYMEGKGIVLREPSVVAKNTQTGEVIAVGSEAKEMIGRTPGTIVAIRPMKDGVIADYDTTAAMLKYFMEKTVGNSKPSVMVCVPSGVTEVEKRAVIDAARVAGAREAFVIEEPFAAAIGAGLPVMDPTGSMVVDIGGGTTDVATISLGGIVSSTSIRQAGDKFNNSIINYIHSNFNLLIGERTAEDIKIQIGSASIEKAKDIESMNIRGRDLVTGLPKSVDVDAVDIAKAIQDVVQDIIVAIKETLEQTSPEIAADVIDHGIVLTGGGALLKNLPEVISEATKVPVFIAQDPLDCVAIGTGESLKNIEVMRRSRK

SEQ ID NO: 85 - DNA, 987 bp, Lactobacillus acidophilus
  misc_feature (0)...(0): ORF 780 - cell shape det. prot. MreB
  CDS (1)...(987)
gtggcacgagatataggaatcgatttagggacagctaatgtactaatcaatgtttctggtaagggtatcgttttaaacgaaccttcagttgttgctgtgaatactgatacaaataaagtagttgcagttggctcggatgcatatgaaatggtaggtagaactcctggtaatattcgtgtaattcgcccattaaaaaatggggtaattgcagactttgatattacagaagaaatgctgtcttactttattgaaaaattaaacgttaaaggctttatgtccaagccaaatattttaatttgtgctcctacaggagttacttcaattgaacaaaaggcaattattcaagcagctgaaaaatcaggtggaggaaaagtttaccttgattttgaaccaaaggttgcagctgtaggtgccggcttggatatttttaagccacaaggtaatatggtaatcgacatcggtggtggaacaactgatgttgcagttttatctatgggtgaaattgtaacttctcgttctttacgttatgctggtgatcgaatgaatcaagctgttattagttatattaagaacaagcataatttgttaattggttctagaactgctgaacaaatcaaaattgaaattggtagtgcattcgaaccagaagaagataagcaaattactgtacgtggtcgtgacgtggttgatggtttacctaagcaaacaacagtcactgcgccagagattcaatcagctttgcaagatggattaatgtctattgttgcagcagctaaagaagttttggaaactacaccacctgagctttctgccgatatcattgatcgtggtatcatgcttacaggtggtggagcattattaaagaatattgataagttgatctcatattatttgcaagtaccagttttaacagctgatcatccacttgaagcagttgctttaggtacaggtactttgcttaaaaatattgaaaagcatcaacgacac

SEQ ID NO: 86 - protein, 329 aa, Lactobacillus acidophilus
MARDIGIDLGTANVLINVSGKGIVLNEPSVVAVNTDTNKVVAVGSDAYEMVGRTPGNIRVIRPLKNGVIADFDITEEMLSYFIEKLNVKGFMSKPNILICAPTGVTSIEQKAIIQAAEKSGGGKVYLDFEPKVAAVGAGLDIFKPQGNMVIDIGGGTTDVAVLSMGEIVTSRSLRYAGDRMNQAVISYIKNKHNLLIGSRTAEQIKIEIGSAFEPEEDKQITVRGRDVVDGLPKQTTVTAPEIQSALQDGLMSIVAAAKEVLETTPPELSADIIDRGIMLTGGGALLKNIDKLISYYLQVPVLTADHPLEAVALGTGTLLKNIEKHQRH

SEQ ID NO: 87 - DNA, 849 bp, Lactobacillus acidophilus
  misc_feature (0)...(0): ORF 799 - cell shape det. prot. MreC
  CDS (1)...(849)
atgaaaaaatttctacaaaacaaaaaattattatcagcatttattatagttgttgttattttggccgttttaggtgggagtgttaatttgcgcaataagcgtaacacgccattattaattcaaagtttaggcaatgatgttgttgcttggggaactagaatcgtagatgttcctgttggctttatatcgggcggtctaaatagtgttcatgatattttaaatactcaagaagaaaataatcatttaaaacgcgaagttactaacttaggtcaaactaaagcgagaaattcagtattagaaaaagaaaatagtcaattaaaatcagcattaaaattaagagatacattaagtggctatactttagttaatgcctcagttatttctcgtgcacctgatacttggtcagatttattgacaatagataaaggtagttctgctggaattaaaaagaatatggccgtaatgtgtggtggcggtgtcattggtagaatcattgaaaccaatgctgcttcatcgaaggtggaattaattactacaactgatgaatcagctaaccgtttttcagttcaagcagatgcagctagtggtaaaacagttcatggaattattactgtaactaataataataatctggcctttactcaagtagttgatggtcaaaaattaaaagccggtacacgtgtttatactagtggtatgggaggcaattctcctaaaggacttttgattggtacagtaactactacaactcgtgattcatttggtttatcagatcagattagaattaagccagcaggtaatattaatgatccatcagttgtaacagttattgaaagacaggtggctaat

SEQ ID NO: 88 - protein, 283 aa, Lactobacillus acidophilus
MKKFLQNKKLLSAFIIVVVILAVLGGSVNLRNKRNTPLLIQSLGNDVVAWGTRIVDVPVGFISGGLNSVHDILNTQEENNHLKREVTNLGQTKARNSVLEKENSQLKSALKLRDTLSGYTLVNASVISRAPDTWSDLLTIDKGSSAGIKKNMAVMCGGGVIGRIIETNAASSKVELITTTDESANRFSVQADAASGKTVHGIITVTNNNNLAFTQVVDGQKLKAGTRVYTSGMGGNSPKGLLIGTVTTTTRDSFGLSDQIRIKPAGNINDPSVVTVIERQVAN

SEQ ID NO: 89 - DNA, 537 bp, Lactobacillus acidophilus
  misc_feature (0)...(0): ORF 800 - cell shape det. protein MreD
  CDS (1)...(537)
atgtctgtttttcgtaaatgggttttagcaattagcttatttgttgctttagtcttagaaggcgtttgttcattttatctacaccaatttatgacttatggtaactatggagcttttagtgtaatcttgccaattagtattatgttaattggtttatttgatgatactaatgagaatgaaatttggttagctttgggtacaggaattattgccgacatctatttttatggaataatcggtatttataccgtatttttgccacttagctgttgggctggccaaaaaattgctcgttttttacctgaaatattttgggcacgattaattgtagttttaatagatacgactgcgtttatcgtttatagttggttagtatttaaaatgattggctttgcgtcaatttcaattcatatgcttttaatgagtttattagtaaatctaggttggacaattttattttttgttctgctatattggatttggggtaatttagcacaagattatcctttcttaatagatttgaatgcatatcgagta

SEQ ID NO: 90 - protein, 179 aa, Lactobacillus acidophilus
MSVFRKWVLAISLFVALVLEGVCSFYLHQFMTYGNYGAFSVILPISIMLIGLFDDTNENEIWLALGTGIIADIYFYGIIGIYTVFLPLSCWAGQKIARFLPEIFWARLIVVLIDTTAFIVYSWLVFKMIGFASISIHMLLMSLLVNLGWTILFFVLLYWIWGNLAQDYPFLIDLNAYRV

SEQ ID NO: 91 - DNA, 1191 bp, Lactobacillus acidophilus
  misc_feature (0)...(0): ORF 782 - rod shape-det. protein RodA
  CDS (1)...(1191)
atggcaaaagttgaaaataagacgagcttagtagatcgattagcttggaatatcattattcctgtagcacttttggctttaattagtttgtactgtatttatgtagcagctttaggtgatccgagtcatattggttcaccagttagagcggttgttatgcaggcattatggtatttaatttcggtagcaattgttatagtggtcatgcagtttgatgcagatcaattgtttaaaattgctccgatattttttggaatagcgatattcttgctgatagcggtattgttcttgtataaccgtagtgtggccgcagatacaggggctaaaagttggtttaaattagggccgattacttttcagccttcggaattaatgaagcctgcttttattttaatgctggctcgcgtgattaaagaccataatgacaaatatggtcatacgatccgaactgactggcttcttttaggtaagataattgcctggttagctccggtagcaattttattaaaattacaaaatgactttggtactatgttagttttcattgccatcgttggtggtgtagttttagtttccgggatatcatggaaaattatcattccgatttatggtatggtaattatcggtgcgattgctataattttgttagttgtaactccaggtggacagtcatttttgagtcatttcttccaagcttaccagtttgaaagaattaaatcatggcttgatccatctggcgatacgtcttctggtgcttatcaattatggcaaagtatgaaggcgattggttcaggacaattgtttggtaatggctttggtaaagctagcgtatatgttccagttcgtggatctgacatggttttctcagttattggtgaaaactttggttttgtcggctgtgtagttttgattttgatttatttatacttaattgtccaaatggtaagaatttcatttgatacaagaaatgtattttattcatatatttctaccggtgttatcatgatgattttattccatgtttttgaaaatattggtatgaatattgatttgttaccattgactggtattccattaccgtttgtatcgcaaggtggttccgctttgttaggtaacatgatcggtatcggtttgatcttatcaatgaaattccataatcgtgattacatgtttagtacagcaggcgatttt

SEQ ID NO: 92 - protein, 397 aa, Lactobacillus acidophilus
MAKVENKTSLVDRLAWNIIIPVALLALISLYCIYVAALGDPSHIGSPVRAVVMQALWYLISVAIVIVVMQFDADQLFKIAPIFFGIAIFLLIAVLFLYNRSVAADTGAKSWFKLGPITFQPSELMKPAFILMLARVIKDHNDKYGHTIRTDWLLLGKIIAWLAPVAILLKLQNDFGTMLVFIAIVGGVVLVSGISWKIIIPIYGMVIIGAIAIILLVVTPGGQSFLSHFFQAYQFERIKSWLDPSGDTSSGAYQLWQSMKAIGSGQLFGNGFGKASVYVPVRGSDMVFSVIGENFGFVGCVVLILIYLYLIVQMVRISFDTRNVFYSYISTGVIMMILFHVFENIGMNIDLLPLTGIPLPFVSQGGSALLGNMIGIGLILSMKFHNRDYMFSTAGDF

SEQ ID NO: 93 - DNA, 1311 bp, Lactobacillus acidophilus
  misc_feature (0)...(0): ORF 1579 -  UDP-N-acetylmuramate-alanine ligase
  CDS (1)...(1311)
atgttagataaaaacaaacaaatttggtttattggtattaaaggaacaggtatggcttcattggccttattgcttcacgatttaggctacaacgttgccggaagtgatattgaaaagtacacttttacagaagttccgcttgaaaaagttgggattgatattaagagctttaatcctgacaatatcaagagtaatgaagaacaagtaatcgttaagggtaatgccttcaaggaagataatccagaagttaaggcttgtcttgataaaggcgttaagtggcaaagctacccagatactgttgaagaaatcgtgcaaatgcacacttcaattggaatttcaggtacccacggtaagacctcgactactagtcttttagcacacgttttaggcgaagttgcaccaacttcatatttgatcggtgatggtcgcggtaagggtgtagacgactcacgtttctttgtttatgaagctgatgaataccgtcgtcacttcttggcataccacccagattaccaaattatgactaacatcgattttgatcacccagattacttcaaagatcaagacgattacactagtgcattccaatctgcagctgatcaaactaaaaaggcattgtttgtatggggtgatgacaagcgtcttcaaagtcttaagactgatattcctaaatatacttatggctttaaggatactgatgacttccaagcagttgatattaagaagacaactactggttcgagctttaacgttttagctcatggtaaggatcttggtcgttttgaaattcatttgtttggtgaccacagtattttaaatgctactgcagttattgccgttgcttatactgaaaaggtaccaatggatgcaattagagaaggtcttcttacttttaaaggggctaagcgtagatttagtgaaaaagactttggtgatattgccgtaatcgacgactacgcacaccatccaactgaaatgcgtgcaactattcaagctgctcgtcaaaagttcccagataagaagttagttgttgttttccagccacatactttctcaagaactaagaagtaccaaaaggactttgaagaaattttacgtgatgtagataaggcatatattaccccaatctatgcttcagctcgtgaagcaaatggcgatattaccagtgaagatttggttaagaatattccaggttcagaagttatcgacttagataatattgccgatttaactaagaataagaattctgtcatcgtatttatgggtgctggcgatattcctaagtatgaagatgcttttgaaaagttactt

SEQ ID NO: 94 - protein, 437 aa, Lactobacillus acidophilus
MLDKNKQIWFIGIKGTGMASLALLLHDLGYNVAGSDIEKYTFTEVPLEKVGIDIKSFNPDNIKSNEEQVIVKGNAFKEDNPEVKACLDKGVKWQSYPDTVEEIVQMHTSIGISGTHGKTSTTSLLAHVLGEVAPTSYLIGDGRGKGVDDSRFFVYEADEYRRHFLAYHPDYQIMTNIDFDHPDYFKDQDDYTSAFQSAADQTKKALFVWGDDKRLQSLKTDIPKYTYGFKDTDDFQAVDIKKTTTGSSFNVLAHGKDLGRFEIHLFGDHSILNATAVIAVAYTEKVPMDAIREGLLTFKGAKRRFSEKDFGDIAVIDDYAHHPTEMRATIQAARQKFPDKKLVVVFQPHTFSRTKKYQKDFEEILRDVDKAYITPIYASAREANGDITSEDLVKNIPGSEVIDLDNIADLTKNKNSVIVFMGAGDIPKYEDAFEKLL

SEQ ID NO: 95 - DNA, 1356 bp, Lactobacillus acidophilus
  misc_feature (0)...(0): ORF 765 - UDP-N-acetylmuramyl tripeptide synthetase
  CDS (1)...(1356)
atgtacatgagttttaaatcaggaatcgctaaagttgctggaaaatctagttattggtttttacacaatgttttaaaaggtggtactagttttcctggcaaatttgcaatgaaaatcgatccaaatgttcttaactctttagccaaaggttatgaaacagtgattgttacaggtaccaatggtaaaactatgacaactgctttgattgttgaagcattgaagaaaaaatatggtgacgttttaactaatccatctggttcaaacatgcaacaaggtattgtcacagcatttttagctcataaaaataagcatgttaaacgtaaaatcgctgtattagaagttgatgaagctaacgtaaaaatggttacgaaattgcttcatcccagcgtctttgttttaactaatattttccgtgatcaaatggatcgttatggtgaaatctataccacttatgaaaaaattgttgatggtattaaactagcacctgacgctacaattattgccaatggtgacgccagcatcttttcatcagtagatttaccaaataagaaaattttctacggtttcaaattgcctgacgataaaaaagagaatgattttaaagcaccagttaatactgatggcgttctttgtccaaaatgtgatcatattttacattatcatgaaagaatttacgcaaacttaggtgacttcttctgccctaactgcggctatcatcgtcctgatttaacttttaccgttaacaagattcttgaacaaacacctaacagcgtaaaattccaaatgggtaataaggattattcgattaatattggtggtacctacaatatctataacgctttagctgcatattctgttgctcgccattttggtttaactgaagcagaagttgcacaagcatttgctgaaaataagcgaatctttggccgtcaagaattgattcactacggcggaaaagacattgatttaatcttggttaagaatccggttggacttgatgaagttcttcatatgcttaacactgaaaaagatgattattcattagtagctttattaaatgcaaaccatgccgatgggattgatacttcttggatttgggatgcagactttgaaggacttgatcgtagcaagattaagaaagtacttgttggtggccagcgctggcacgacatgggatttagacttgaaatcgctggttttgatccaggcaagatgagtactaatccagatgatgatagcttgattgaagaaatcaagaaattaccaaccaagaaggtttacattctttcaacttatactgcaatgcttgcacttagaaagaaaatggctgaaaagaaaattatcaaagctggtatg

SEQ ID NO: 96 - protein, 452 aa, Lactobacillus acidophilus
MYMSFKSGIAKVAGKSSYWFLHNVLKGGTSFPGKFAMKIDPNVLNSLAKGYETVIVTGTNGKTMTTALIVEALKKKYGDVLTNPSGSNMQQGIVTAFLAHKNKHVKRKIAVLEVDEANVKMVTKLLHPSVFVLTNIFRDQMDRYGEIYTTYEKIVDGIKLAPDATIIANGDASIFSSVDLPNKKIFYGFKLPDDKKENDFKAPVNTDGVLCPKCDHILHYHERIYANLGDFFCPNCGYHRPDLTFTVNKILEQTPNSVKFQMGNKDYSINIGGTYNIYNALAAYSVARHFGLTEAEVAQAFAENKRIFGRQELIHYGGKDIDLILVKNPVGLDEVLHMLNTEKDDYSLVALLNANHADGIDTSWIWDADFEGLDRSKIKKVLVGGQRWHDMGFRLEIAGFDPGKMSTNPDDDSLIEEIKKLPTKKVYILSTYTAMLALRKKMAEKKIIKAGM

SEQ ID NO: 97 - DNA, 1596 bp, Lactobacillus acidophilus
  misc_feature (0)...(0): ORF 1818 - UDP-N-acetylmuramoyl-L-alanyl-D-glutamyl-lysine ligase
  CDS (1)...(1596)
atgtttttaatacaacgaggagaaaaaatgagtatttctttaaatacctgtatattaattttaaaagagcaccatttgctcaagtcaagcgcagtgcaagatactgtagcaaccaagatggactacgtttcttatgactcacgcgatattcaaactaacacattgtttttctgtaagggagcaggctttagaccaacttatttatcaatggctaaaagtaatggagcaaattgttacgttgctgaacaaccatatcctgaaggtaaaggaatgcacgctttaattgttcgcgatgtttcaaaggcaatggcattattgtcagcggcatttttccgtttcccacaagatgatttgtatgttgttgcattcactggtactaagggaaagactacttcggcatactttttgaaggggatgcttgatcaagcaaacggtggtagaacagctttaatttcttcagttaatgatgttgttgggccaaagccagaagatagctttaaatcaagtttaactacaccagaaagtttggacttgttccgtgatatgcgtactgctgttgataacggtatgactcaccttgtaatggaagtttcaagtcaagcttataagaagaaccgtgtatttggattaacttatgatttaggtttctttttaaatatcagtccggatcatattggaccaaatgaacaccctaactttgcggattacttgcactgcaagttgcaattgatggttaactcacgtaaatgtattattaacgcagaaactgctaactttaatgaagtatatgcagcagcaacaacgactactaatccagatagcatttacttgtttgcaagagaagattttgaaaatccagatttggatgtgccaattgactttagatttgcttcccaagaattggatatgaaagaaactcgctttaagttgttctgtgccactgataaggctaagaagttgcctattaatggtgattacactttaaagatgttgggtgactttaatgaatcaaatggtacagctgccatcattggtgcaggacttgccggtcttaaccatgatcaatgtgctaaggggatccgtaatgttactatccctggtcgtatgcaaactgaaagaactaaagaacacggtatggttgttgttgattatgcccacaataaggcttcgatgatggctttgatgagattcatgcaaaatgaatttaacgatcctaagatcatcgtagttgttggtgcacctggtgataaaggcgtttcacgtcgtccaggctttagtgaaagtttgagtgcatatgctgataaggcatttttgacaactgatgatccaggatttgaagatccaaagtctattgctgaagaaattgatgctggtattgatcactctaagtgtgatgtaacaattgaattggaccgtaagaaagctattcatgatgcaattgcttcagctggtccagatgatgtagttttaatctgtggtaagggtgctgacgctttccaaaagattcgcggcgtagacactccatatccatcagatattgtggttgctcaacaggtaattaacgaattagaaggccaagacgagcactttagaaaa

SEQ ID NO: 98 - protein, 532 aa, Lactobacillus acidophilus
MFLIQRGEKMSISLNTCILILKEHHLLKSSAVQDTVATKMDYVSYDSRDIQTNTLFFCKGAGFRPTYLSMAKSNGANCYVAEQPYPEGKGMHALIVRDVSKAMALLSAAFFRFPQDDLYVVAFTGTKGKTTSAYFLKGMLDQANGGRTALISSVNDVVGPKPEDSFKSSLTTPESLDLFRDMRTAVDNGMTHLVMEVSSQAYKKNRVFGLTYDLGFFLNISPDHIGPNEHPNFADYLHCKLQLMVNSRKCIINAETANFNEVYAAATTTTNPDSIYLFAREDFENPDLDVPIDFRFASQELDMKETRFKLFCATDKAKKLPINGDYTLKMLGDFNESNGTAAIIGAGLAGLNHDQCAKGIRNVTIPGRMQTERTKEHGMVVVDYAHNKASMMALMRFMQNEFNDPKIIVVVGAPGDKGVSRRPGFSESLSAYADKAFLTTDDPGFEDPKSIAEEIDAGIDHSKCDVTIELDRKKAIHDAIASAGPDDVVLICGKGADAFQKIRGVDTPYPSDIVVAQQVINELEGQDEHFRK

SEQ ID NO: 99 - DNA, 1377 bp, Lactobacillus acidophilus
  misc_feature (0)...(0): ORF 808 - UDP-N-acetylmuramoylalanine-D-glutamate ligase (murD)
  CDS (1)...(1377)
atgaaagatattaaaacttatgataataagaatattttagttttaggattaggaaaaagtggctttgcagttagtgaacttcttttaaaattaggtgctaatttaactttaaacgataaagctgatcttgataaaaatgaaaaggcacaagaattaaaagctaaaggtgtgcgcgtaattggcggatatcatccagttgatttgcttgaagaagaacattttgattatttagttaaaaatccaggtattccgtatgaaaatccaatggttaaaaaagctgaagaattagatattccaattatcactgaacctgaagttgctttaagctgtagtgacgctccttatgtatgtattactggttcaaatggtaagactactactgtaatgcttacacaaagaattttggatcatcatttacaaaaaacaggccatcatgcatatgcagttggtaatattggtgttcctatttcagaagtagttcctaaagctactaaagatgatattttagtagttgaaatttcaagtttccaattattaggtgtaactgatattaagcctaaggtagcagcgattgttgatatctataataatgttcaccttgattatcataagactttcgaaaattacgttgatgctaaattaaacgttactagaactcaaaatagcgatgattactttattgctaactttgatcaaaaagatattttggcaaaagaaaaagaagtatccccagccaaaatgcagactttctcagaaactgatcacaatgctgattactttattggtgatgagtatcttgaaagtcaagacgaaaagattatgaagattgcggatattaaacttccaggcgttcataatttacaaaacagtcttgtagcaattgcaattgctaaacttatgggagcagataatgaagatattgctgctgtattaagtacttttactggtgctaaacatcgtttacaatatgtaacaacacttgatggacgtaagatttataatgattctaagtcgactaatattgaagctgctacggtagctattcctgcgtttaaagaacccgaagttttgattgcagggggactagacagaggatttacatttgatgatttagttccattatttaagaaacatgttaaatcaattgtactttatggtgaaactaaatatttattagctgatgccgctagaaaagcaggtattaaggagattgtaattgttaatacccttcaagaagcagttcctagagcatatgaattaactgaaccaggtgatgtaatactattttcacctgcatgtgcttcatgggatcaatttagaactttcgaagaacgtggcgattactttgttagatttgttgaggaattaaaaactaaa

SEQ ID NO: 100 - protein, 459 aa, Lactobacillus acidophilus
MKDIKTYDNKNILVLGLGKSGFAVSELLLKLGANLTLNDKADLDKNEKAQELKAKGVRVIGGYHPVDLLEEEHFDYLVKNPGIPYENPMVKKAEELDIPIITEPEVALSCSDAPYVCITGSNGKTTTVMLTQRILDHHLQKTGHHAYAVGNIGVPISEVVPKATKDDILVVEISSFQLLGVTDIKPKVAAIVDIYNNVHLDYHKTFENYVDAKLNVTRTQNSDDYFIANFDQKDILAKEKEVSPAKMQTFSETDHNADYFIGDEYLESQDEKIMKIADIKLPGVHNLQNSLVAIAIAKLMGADNEDIAAVLSTFTGAKHRLQYVTTLDGRKIYNDSKSTNIEAATVAIPAFKEPEVLIAGGLDRGFTFDDLVPLFKKHVKSIVLYGETKYLLADAARKAGIKEIVIVNTLQEAVPRAYELTEPGDVILFSPACASWDQFRTFEERGDYFVRFVEELKTK

SEQ ID NO: 101 - DNA, 1104 bp, Lactobacillus acidophilus
  misc_feature (0)...(0): ORF 809 - p-N-acetylmuramoyl-pentapeptide-transferase (murG)
  CDS (1)...(1104)
atgagagttatatttacaggtggtggcacaggtggtcacatttatccaatcatggcaattattgaacgtttgaaagaacgtggcattagtaaaaacgatgaaatcttatttgtaggtacacaaaagggattagaatcaaaaattgtgcctgctgcaggtgttaattttgaaacaatccaaattcaaggatttaatcgtaaacacccgttaaaaaattttgaaacaattaaattgttcttccaagctaccaagagcgcacgtaaaattttgcaagaatttaaacccgatgtcgttttaggtactggtggttatgtgagtggtgctatggtatatgaagctgcaaaaatgcatatccctactatgattcatgaatcaaattctgttgtcggattagctaataaattcttggggcattatgttgataagatttgttatacttttgatgacgcagctaaagaattccctgagaaaaagaaattggtaaaaacaggaaatccgcgttcacaacaagttttaggtcttcatgaagataaggtgaacttgcaaaaagaattaggcttaaatccgcaaatgccaactgtcttagtatttggtggatctcgtggtgcattagcaattaaccgaattatgcttaaatctttgatggaacttaagaaaaagccatatcaaattatttgggctactggtacctactactttgattctgttcaaaagaaattagagggcgttgactatggtgataacattaagattttgccatatattcaaaatatgcctgcattacttccagaaatgacatgtgttgtttcaagatctggtgcaacaagtatagctgaatttactgctttaggtgtacctgtcattttaattcctagtccaaatgtaactcataatcaccaaatgaagaatgcgcttgatttacaaaaagcaggtgctgcattagtaattcctgaagatgatttaaatcctaataatttcgtttcttctattgatcatattttattagatgaaaaatatgctaatgaaatgagtgaagcctcaaaagcacttggagtaccagatgcatctgatcaagtaattaaagtgatggaagaaatttcacgc

SEQ ID NO: 102 - protein, 368 aa, Lactobacillus acidophilus
MRVIFTGGGTGGHIYPIMAIIERLKERGISKNDEILFVGTQKGLESKIVPAAGVNFETIQIQGFNRKHPLKNFETIKLFFQATKSARKILQEFKPDVVLGTGGYVSGAMVYEAAKMHIPTMIHESNSVVGLANKFLGHYVDKICYTFDDAAKEFPEKKKLVKTGNPRSQQVLGLHEDKVNLQKELGLNPQMPTVLVFGGSRGALAINRIMLKSLMELKKKPYQIIWATGTYYFDSVQKKLEGVDYGDNIKILPYIQNMPALLPEMTCVVSRSGATSIAEFTALGVPVILIPSPNVTHNHQMKNALDLQKAGAALVIPEDDLNPNNFVSSIDHILLDEKYANEMSEASKALGVPDASDQVIKVMEEISR

SEQ ID NO: 103 - DNA, 966 bp, Lactobacillus acidophilus
  misc_feature (0)...(0): ORF 806 - p-N-acetylmuramoyl-pentapeptide-transferase (mraY)
  CDS (1)...(966)
atgagtattatgctagcaagttgtattgctttagttagttcactagtgttgacggtaatttttttacctgtcttgattaatttcatgcattctcaccatgaggggcaagaaattcgtgatgaagggcctaaatggcaccaaaagaagtcaggaacgcctacaatgggaggaaccatctttgtaattgcggcagttatctctgttatttgggtagctgcctggcaacatagtttaaacaaagttgtctggattttagtaatcagtttattaggatatggaattattggttttcttgatgatggtattaagctttactataagcgtaatttgggattaagagcttggcaaaagttggcattgcaaattattattgccgttgtaattgtcttgattgcctcaagcgatcattttcaatttggtttatatattccttttgcaggtgttgttcatagtattgcattatttactatcttcattattttctggctggttggtttttctaatgctgttaacctttcagatggtcttgatggtttagcaactggtttatcaattgtggcatatggtacatatgcttatattgcatttaaacaaaagaattttgccgttttggctttttgtatgagtgtgatcggtggattaattgccttctttatttttaaccataagccggctaaaatctttatgggggatgcgggttcacttgctcttggtggtggacttgcaaccgtaagtattatgcttaacagaccatggtcattattacttatcggtattgtatttgtttgtgaaactgctagtgtaattttacaggttatttcattccaaactacaggtaagagaatttttaagatgactcctattcaccaccactttgaaatgcttggttggtcagaatggaaagttgatattgtcttttggcttgttggcttaatttgtagtattttgtatttagcaatttgggga

SEQ ID NO: 104 - protein, 322 aa, Lactobacillus acidophilus
MSIMLASCIALVSSLVLTVIFLPVLINFMHSHHEGQEIRDEGPKWHQKKSGTPTMGGTIFVIAAVISVIWVAAWQHSLNKVVWILVISLLGYGIIGFLDDGIKLYYKRNLGLRAWQKLALQIIIAVVIVLIASSDHFQFGLYIPFAGVVHSIALFTIFIIFWLVGFSNAVNLSDGLDGLATGLSIVAYGTYAYIAFKQKNFAVLAFCMSVIGGLIAFFIFNHKPAKIFMGDAGSLALGGGLATVSIMLNRPWSLLLIGIVFVCETASVILQVISFQTTGKRIFKMTPIHHHFEMLGWSEWKVDIVFWLVGLICSILYLAIWG

SEQ ID NO: 105 - DNA, 645 bp, Lactobacillus acidophilus
  misc_feature (0)...(0): ORF 527 - N-acetylmuramidase
  CDS (1)...(645)
atggcaaaaaagcataaatcaagaatacccaaaagtgtaaaaattgttgttcgcgcatttattattttgtttgtcttgcttgtagcctttattggctttcgttattatagaagatatgcgattcaatcagagcagattagacaagcacagctgcagcgagaacaagaagcagcaaaattattaaagcagaaaaaagattttatcaaaaaagttggcccgattgcacaagcagtagataagtcatacgatttattgccgagtatcacgattgctcaagcttgccttgaaagtaattatggtcaaagtgatttgtcgcaaaaatataacaatttgtttggcgttaaggggaccaatccaaatacttcggctgtgatgacgaccaaagaatatgttaaaggaaagtggatcactgttaaggctcgttttcaaatatatgactcatatgaggcttcaatcagagcccatgctagattattccagaatgggacaacgtggaatcacgaccaatataagcacgttttagcgtctaaagattataagacacaggctaaagcattagtaacagatggctatgcgacggatccagattatgcagataagttgatcaatttaattgaacaatttgatctagaaaaatatgataag

SEQ ID NO: 106 - protein, 215 aa, Lactobacillus acidophilus
MAKKHKSRIPKSVKIVVRAFIILFVLLVAFIGFRYYRRYAIQSEQIRQAQLQREQEAAKLLKQKKDFIKKVGPIAQAVDKSYDLLPSITIAQACLESNYGQSDLSQKYNNLFGVKGTNPNTSAVMTTKEYVKGKWITVKARFQIYDSYEASIRAHARLFQNGTTWNHDQYKHVLASKDYKTQAKALVTDGYATDPDYADKLINLIEQFDLEKYDK

SEQ ID NO: 107 - DNA, 1227 bp, Lactobacillus acidophilus
  misc_feature (0)...(0): ORF 176 - N-acetylmuramidase
  CDS (1)...(1227)
atgaagaagagacttttgaccagcattgctagtgcagctatgctgacaacagtagctaccccagtagtgaataatgtaatgatgactaccgctcatagccaaaaggtttctgctgccaccactgatgaacaagctgcttttttgaacaaggctgccaagcaagcagttaaagccgctaagaaatacggaacttatccatcagttatgattgcacaagccatcttagaatctggctggggacaatcagcccttgcaactgaagctaacaacctttttggtatgaaggctgatgatagctggccaggtgagacttattctgctaagactagagaagaaggcaccaacggtaagagttactatattgtagctaaatttagaaaatataactcatttgaagaatcatttgaagataatggcaagaaacttcgtgaaggtgtgtcttggcaaccgcttcgctataagggaacttggcttgaaaatgccaatacttatgctgatgcaacgaagtctttaactggtacttacgccactgatagtaagtatgacagttcacttaactcaagaattaccgatcataatttgaaccaatatgatccaattgtttcgaaaactgctaaggtttacaccgtatctaagtcaggctcagtttataattggccaactgaccactcagtagctagccctgttggaactgttaagaagggcgagagggttgttgcaactaagactattacctataatgacggttcaactcgtatgtaccttgaaggtaaaggctggattaacggtacttcacttggtaagggtaattctaagagtagcgaaccaatcactcaagcacctaagggcgcaactaaggtagacaagaccttaatgcacaatgcctacgtttacgataacaagggtacaaagattaagggtaagatgttcaagcttaacgaagaagaagatgttaagatgatcagtacctatggcacaaagactattaagggtaagacttactaccgtgtaggcgagaatgaatacattgcagccggcaacattgacggtacgcttaaattcttaaagcgtaattcttacgtctataaccaatacggcaatcgcgataacagtttgaagcgcaagaagaacgaacaagttgctacctacggtgcagcagttactattaacggtaagaagtattacagaatcggtattcgccaatacattaaaaaagctaacttcatg

SEQ ID NO: 108 - protein, 409 aa, Lactobacillus acidophilus
MKKRLLTSIASAAMLTTVATPVVNNVMMTTAHSQKVSAATTDEQAAFLNKAAKQAVKAAKKYGTYPSVMIAQAILESGWGQSALATEANNLFGMKADDSWPGETYSAKTREEGTNGKSYYIVAKFRKYNSFEESFEDNGKKLREGVSWQPLRYKGTWLENANTYADATKSLTGTYATDSKYDSSLNSRITDHNLNQYDPIVSKTAKVYTVSKSGSVYNWPTDHSVASPVGTVKKGERVVATKTITYNDGSTRMYLEGKGWINGTSLGKGNSKSSEPITQAPKGATKVDKTLMHNAYVYDNKGTKIKGKMFKLNEEEDVKMISTYGTKTIKGKTYYRVGENEYIAAGNIDGTLKFLKRNSYVYNQYGNRDNSLKRKKNEQVATYGAAVTINGKKYYRIGIRQYIKKANFM

SEQ ID NO: 109 - DNA, 459 bp, Lactobacillus acidophilus
  misc_feature (0)...(0): ORF 966 - N-acetylmuramidase
  CDS (1)...(459)
atggataaaaaatcaactggaccataccagcattatgaacggcctactaagaagaggagctcacaagataagcaaccgagaggctcagcccgctggattgcagttattgtaattttagcagttattttgattactcttattccagctgttcatcgcttggcttcaaagcactctcaaaaagctgaggaagttcaaactcttaaaaaggtttcttctagttctgctaaatcatcaaaagaaaagaaaacttcgtcttcttcagctaaaaagagttcgtcacaatctagttcaagctcaagctcgtctaaagagacaacacctaagacttatactgttcaaacaggtgatactttaactagtattgcagagcaatatggtatgacagttgatcaattagccagattaaataatcttgaagactcttcaaacgtcaatattggccaaacacttaagttgaaa

SEQ ID NO: 110 - protein, 153 aa, Lactobacillus acidophilus
MDKKSTGPYQHYERPTKKRSSQDKQPRGSARWIAVIVILAVILITLIPAVHRLASKHSQKAEEVQTLKKVSSSSAKSSKEKKTSSSSAKKSSSQSSSSSSSSKETTPKTYTVQTGDTLTSIAEQYGMTVDQLARLNNLEDSSNVNIGQTLKLK

SEQ ID NO: 111 - DNA, 1080 bp, Lactobacillus acidophilus
  misc_feature (0)...(0): ORF 137 - d-alanine-d-alanine ligase
  CDS (1)...(1080)
atgactaaaaaaatacaagtcggattaatttttggtggtaactcatcagaatatgaagtatcaatcgtttcaggtcataatatttataaggcaattgataaagataaatttgatgtacatccaatttggattactaatgaaggatactttgcaagtgaagaagaaagcttcaaagtcttagaagatccttcgtatcaagtggaaaatccacataaggtaaataatatttcaaatattattgaattgaagaatttaccagagattgatgtattcttcccaattgttcacggtaatttaggtgaagatggggtcttacagggattgtttcgcttgatgaacaagccatttgtaggtgacgatgtcttagctgcagctgcaactatggataaggaatttaccaagattttagctcaaagagttggtgttccagtagctgattggatttcaatcaagcgttttgaatacgatgataagaataatgataaacttaattatgaaaaagtagctgaaaagcttggtcatgatatgtttgtaaaaccatctaaccaaggttcatcagttggcgttaaccatgtaactaatgctgaagaatatgctgcagcattagaagaagcattcaagtacgatgataaggttttagttgaagaaactgttcctggcaccgaagttgaaactgctgtccttggcaacgataagccaattgtagcaggtgttggacaaatcaccaatgcaaaaggctcattctatacttacgaaaataagtatgatgataattcaacttctaagttgcaaattcctgcagatttaccacaagatattgttgatactgtcagagaaaatgctcggaaggtttacgaaattactgaatgtagtggtatggcaagaattgattctatgcttactccagatggtaaagtagtattaactgaagtgaatgcacttcctggttttactaatatcagtatgtatcctaagttattcgaagaagctggtattccttacactgaattgattactcgcttaatccaagcaggtatggatcgttttgaccacaagaagacattgcttcacaagcatgat

SEQ ID NO: 112 - protein, 360 aa, Lactobacillus acidophilus
MTKKIQVGLIFGGNSSEYEVSIVSGHNIYKAIDKDKFDVHPIWITNEGYFASEEESFKVLEDPSYQVENPHKVNNISNIIELKNLPEIDVFFPIVHGNLGEDGVLQGLFRLMNKPFVGDDVLAAAATMDKEFTKILAQRVGVPVADWISIKRFEYDDKNNDKLNYEKVAEKLGHDMFVKPSNQGSSVGVNHVTNAEEYAAALEEAFKYDDKVLVEETVPGTEVETAVLGNDKPIVAGVGQITNAKGSFYTYENKYDDNSTSKLQIPADLPQDIVDTVRENARKVYEITECSGMARIDSMLTPDGKVVLTEVNALPGFTNISMYPKLFEEAGIPYTELITRLIQAGMDRFDHKKTLLHKHD

SEQ ID NO: 113 - DNA, 981 bp, Lactobacillus acidophilus
  misc_feature (0)...(0): ORF 1852 - d-ala,d-ala ligase
  CDS (1)...(981)
atggcacatatgtctaggcgagaatatcgcatgaaaaaagaacatggacaatctggtgctagtcaatcgcgaattaattattctaaaaataagataactagtcgtgaagaatttagaagtaaaaagattagcaatcctgcgccaattaacaatgtgaatgtggctaatgctacaagagaaaattataatcatgtcaaacttaacttttggaatattttctctgataggccatatgtctctgtaacaataattgtgttggctttgttctttattatgatcaaactgtggtggggactcattgtgctgcttattgctgtcatagctggtatttatgtgataggacgtagtcatcatcctaaccgtgtgctgagtctagagtttcatatgaaagcttctagaaaacttagtatgcttagagcctttgaattaggtggctctgttgttatgtttttagcaacttatatgaaacaagtggtttctgtagatttctcatcagcaggatcaaccgatagtttccaaattattcaagggatgctgtctaataatggtggttattatggtcaacgtggatcatatttcttgaatttgcttaatacagtaactggtgggcagttatggagctcttatcggtatgcaaccaatagtgcacaaatgatgagtagtaattcaggaagatggattattatttggatcatgcttttgatgattgctccagcattttgtgtgttggcacagttctttaaagagccatattcaagaaatgcaacattagttacttcattgatcactacggtaagttttgtattaactcctgttttaatgagaagatgggtagtaggttatgcaatggaaaatcaaatggcaagagaagcagccaacaatgcagttcatattggtaccatggcgtatgttggtatggggtgctcaattatggttttgattattgcaatttatcgttttgttaaacaagataattttgaa

SEQ ID NO: 114 - protein, 327 aa, Lactobacillus acidophilus
MAHMSRREYRMKKEHGQSGASQSRINYSKNKITSREEFRSKKISNPAPINNVNVANATRENYNHVKLNFWNIFSDRPYVSVTIIVLALFFIMIKLWWGLIVLLIAVIAGIYVIGRSHHPNRVLSLEFHMKASRKLSMLRAFELGGSVVMFLATYMKQVVSVDFSSAGSTDSFQIIQGMLSNNGGYYGQRGSYFLNLLNTVTGGQLWSSYRYATNSAQMMSSNSGRWIIIWIMLLMIAPAFCVLAQFFKEPYSRNATLVTSLITTVSFVLTPVLMRRWVVGYAMENQMAREAANNAVHIGTMAYVGMGCSIMVLIIAIYRFVKQDNFE

SEQ ID NO: 115 - DNA, 1365 bp, Lactobacillus acidophilus
  misc_feature (0)...(0): ORF 266 - d-ala-d-ala adding enzyme
  CDS (1)...(1365)
atgaaaatgcaaatggctgaaattgccaaagctttagataagacttgtgaaggtgacgataaaacagttattacttctgttgcctttgactccagaaagatcacaaatggtggattatttgtaccacttgaaggtgaacgtgatggacatgattttgtggctggtgctattagtaatggtgcttctgctactttgtggaaaaaggggcatccaaataaacctgaaggtattgcagtaattgaagttgatgatccacttgccgctatgcagacacttgctcgttattatttgcgtaaagttaatccaactgtagtgggaattactggttcaaatggtaagaccactactaaggatatgatcgctgcagttttatcaaagcgtttcaacgtacataagactcaagctaattttaataatgaaatcggcgtgccaatgaccgttcttgaaatgaagccaaatactgaaattttggttcttgaaatgggaatggatagaccaggacaattacatcacttaagtgaattgactcgtcctgatgtagctgtaattaccatgattggtgaagctcatattgagttcttcggtagtcgtgataagattgctgacgctaagatggagatcactgattttctccgtgaagatggagaatttatttataatggtgatgaaccattacttcaagaaagagctaagaagcttgatcaagctaaagcaacttttggttttgaagatgatgacacggttcatgctactggttttaagagttacatgcatcatgcgacttttacaattaatgattcagagcagaaattctctattccaatgatcggtaagcataatgtttctaatgctatggctgctattagtgttggacgtcattttggtgaaagtgatgaggaaattgcgtcatcgttgtctaactttaagccaaccgctaatcgtatggaatgggaaaaaggcgatgttggcgaagcaattatgagtgatatctataactcaaacccaactgcggtaagagctgttattactagctttggccaagttgaggtaaaagatggcggtcgtagaattgctgttttgggtgatatgcttgaattaggtgagaattctccgaagcttcatgccgaattaagcgatactttggatccacaaattattaatgaagtatatttatacggccctgaaatgaaaaatctgtatgatgcattacaaggcaagtatgagtcagagcatttgcattactatactaaagatcaaatggatcgtatgattgatgatcttaaaaatgatattaagtcggacgacattgttgtgttgaaaggttcacacgggatgcacctagaaaatgtcttagcccgactaaga

SEQ ID NO: 116 - protein, 455 aa, Lactobacillus acidophilus
MKMQMAEIAKALDKTCEGDDKTVITSVAFDSRKITNGGLFVPLEGERDGHDFVAGAISNGASATLWKKGHPNKPEGIAVIEVDDPLAAMQTLARYYLRKVNPTVVGITGSNGKTTTKDMIAAVLSKRFNVHKTQANFNNEIGVPMTVLEMKPNTEILVLEMGMDRPGQLHHLSELTRPDVAVITMIGEAHIEFFGSRDKIADAKMEITDFLREDGEFIYNGDEPLLQERAKKLDQAKATFGFEDDDTVHATGFKSYMHHATFTINDSEQKFSIPMIGKHNVSNAMAAISVGRHFGESDEEIASSLSNFKPTANRMEWEKGDVGEAIMSDIYNSNPTAVRAVITSFGQVEVKDGGRRIAVLGDMLELGENSPKLHAELSDTLDPQIINEVYLYGPEMKNLYDALQGKYESEHLHYYTKDQMDRMIDDLKNDIKSDDIVVLKGSHGMHLENVLARLR

SEQ ID NO: 117 - DNA, 1296 bp, Lactobacillus acidophilus
  misc_feature (0)...(0): ORF 1603 - d-alanyl-d-alanine carboxypeptidase
  CDS (1)...(1296)
atggtttttagtaaaaaaataaaacggacattaattagtcttgttgctttagtttctttagtttcttgtggtgcagtatttacaacaccggttagtgcagatacatcaagtagttatcgcaataatgaagtgaatttagatgttaaatctgcaattgcaattgatagtaattcggggcaaattttgtatgctaaaaatgctgataagactttaccaattgcttcaatgacaaagttaattacagtttatttaactttaaatgcaattaaaaataaaaaattatcttggaatcaaaaggtgaagccaactgcttcaattgtaaaagtagctaataatgcggaatattcaaatgtaccgcttaagatggggcattcttatactattcgtcagctttatcaagcaactttaattgaatcagctaatggggccgcaatgcttttgggccaaactattgctggttcacaaaagaaatttattgatcaaatgcgtgcccaagttaaaaaatgggggattgaagatgccgagatttatacggcatgtggtttacctaatggtaatgtaggtaaagatgcctatcctggtgtaaataagaatgctgaaaatactatgtcagctaaggatatggccattgttggacaacatttacttaaagaatacccagaaattttagatactactaaattagctcatttagattttaaagacggtaataaaactactaaaatggccaactttaactggatgcttaaaggactttctcaatatgatcaagcatatccagttgatggattaaagactggtaccactgatgcagcaggtgcatgttttattggtacagttgaacataatggtgctcgtttgattactgttgtcatgggtgcacgtcaccaagatggtacggatccttcacgttttattcaaactaagaaattaatgagttttattttcaacaaataccgtccagttacaatgactgctggaagtcaaataaatggtgcaaaaagtattaaagttactgatggtaaagacgctacaactaatattggtttaaagaataagacaactatttgggatccagcagatggtaaaacattgactgctagtttaaacaaaaaaacaatagatgcgcctcttgaaaagaatcagacagttggtaattatcaattaaaatcaggtagtgaaaaaattgtttcattggataatcctaatggaatgaatgtaaaagctaaagctttatcagctaatggaaaagttaatttctttgttagaatttggcgttggcttttcgggggcaga

SEQ ID NO: 118 - protein, 432 aa, Lactobacillus acidophilus
MVFSKKIKRTLISLVALVSLVSCGAVFTTPVSADTSSSYRNNEVNLDVKSAIAIDSNSGQILYAKNADKTLPIASMTKLITVYLTLNAIKNKKLSWNQKVKPTASIVKVANNAEYSNVPLKMGHSYTIRQLYQATLIESANGAAMLLGQTIAGSQKKFIDQMRAQVKKWGIEDAEIYTACGLPNGNVGKDAYPGVNKNAENTMSAKDMAIVGQHLLKEYPEILDTTKLAHLDFKDGNKTTKMANFNWMLKGLSQYDQAYPVDGLKTGTTDAAGACFIGTVEHNGARLITVVMGARHQDGTDPSRFIQTKKLMSFIFNKYRPVTMTAGSQINGAKSIKVTDGKDATTNIGLKNKTTIWDPADGKTLTASLNKKTIDAPLEKNQTVGNYQLKSGSEKIVSLDNPNGMNVKAKALSANGKVNFFVRIWRWLFGGR

SEQ ID NO: 119 - DNA, 1323 bp, Lactobacillus acidophilus
  misc_feature (0)...(0): ORF 234 - udp-n-acetylglucosamine 1-carboxyvinyltransferase
  CDS (1)...(1323)
ttgaaagtagaaaaggatttgttttcgccaatgaagcagatgattattcatggtggaaagcccttgcagggtgatgtttggatcggtggagctaaaaattcaacagttgcattaatcccagcatcaattttgtcgagaacaccagtagtcttggaaggcgtcccaagaattgctgatgtgatcaacttgatggacttattagatgaaatggatgtacgttgtgagtttaaagaaacaactttacgcattgatccaacagatattaagatgagtccattgccagctggtaagattaagagtttacgtgcatcatattactttatgggtgcacttcttggtcgatttggcaaagcagttgtgggcttccctggtggtgacgatatcggaccacgtcctatagaccaacatattaaaggctttgaagccttaggcgccagcgttaaaaatgaaaatgatcaaattataattactgctccagaagatggcttgcatggtgcgaagattcatcttaagatgccatctgttggggcaacaatgaatattattatggctagtgtaactgcacaaggccaaactattattgaaaatgccgcgaaagaaccggaaattatcgatttagcaaccttcttaaataacatgggggcagttattcgtggtgccggtactgatgtgattcgtattgaaggtgtggaaatgcttaaagcgcaaattccgcatacaattattccagatagaattgaagctggtacttatgtatctcttgctgcgtgcattggtaatggtattcgtattcataatattattgaggaacaccttgattcataccttgctaaggtggaagagatgggcgttgtaattgatgccgatgaagattctctttatgtgtatcctgctggtgatttgaagatggtgcaagtaaagactgatgtttatccaggttttgccacagatttacaacagccgattactccactgcttcttactgctaagtctggtgaaggtgttgtaatcgataatatttatccgcaacgaattggtcatattgctcaattacaaaagatgggtgccaatattaaagttgcagataacatcatcttggctcacccaactgaacaacttcacggtgcagaagtaattgcaggtgagattcgtgcaggtgcatgtttgatgattgctggattgatggcacacggtacgacggttatcgataaagccggtaatattttacgtggttatgatcgaattcaagaaaagttacgtcaacttggtgctgatgtaacgattaaagataaccctgatgtaccaggcattttagataatata

SEQ ID NO: 120 - protein, 441 aa, Lactobacillus acidophilus
MKVEKDLFSPMKQMIIHGGKPLQGDVWIGGAKNSTVALIPASILSRTPVVLEGVPRIADVINLMDLLDEMDVRCEFKETTLRIDPTDIKMSPLPAGKIKSLRASYYFMGALLGRFGKAVVGFPGGDDIGPRPIDQHIKGFEALGASVKNENDQIIITAPEDGLHGAKIHLKMPSVGATMNIIMASVTAQGQTIIENAAKEPEIIDLATFLNNMGAVIRGAGTDVIRIEGVEMLKAQIPHTIIPDRIEAGTYVSLAACIGNGIRIHNIIEEHLDSYLAKVEEMGVVIDADEDSLYVYPAGDLKMVQVKTDVYPGFATDLQQPITPLLLTAKSGEGVVIDNIYPQRIGHIAQLQKMGANIKVADNIILAHPTEQLHGAEVIAGEIRAGACLMIAGLMAHGTTVIDKAGNILRGYDRIQEKLRQLGADVTIKDNPDVPGILDNI

SEQ ID NO: 121 - DNA, 1377 bp, Lactobacillus acidophilus
  misc_feature (0)...(0): ORF 219 - udp-n-acetylglucosamine pyrophosphorylase
  CDS (1)...(1377)
atggaaaaatacgtagttgttcttgctgcaggcaagggtacacgaatgaagtctaaattgtataaggttttgcataaagtttgcggtaagactatggttgaacatgtcgtagatgctgcaagtggtgttgagcctactgaaattgttactgttgtaggtactggtgctggcgatgtggaaaaagttttggctgacaagtcaaaattcgttttccaagaaaagcaactcggtaccggtgatgccgtgatgactgctaaagaagtcttaggtgacaaagatggtgcaacattagtagttactggtgatactccattatttactactgatactttcaatgaattgtttaagtatcatacagaaaaaggcaatgcagctactgttttaactgctgaagctccaaatccatttggttatggtcgaattattcgtgatgagcaaggcaatgttttaagaattgttgaacaaaaagacggtaatccagaagaattaaaggttaaggaaattaacactggtgtattttgctttgataataaaaagttatttgaagcattaaaacatgttgataataataacgctcaaggtgagtactacttgactgatgttcttgaaattttgcgtaatagtggtgaaaatgtcggtgcatataagatgcctgattttagtgaaagcttaggtgttaatgatcgtatcgctttagcccaagctactaagattatgcaaagaagaattaatgaagaacatatgcgtaatggtgtttcattcattgatccagatactgcctatattgatgctgacgtaaaaattggtaatgatacagtaattgaaggtaatgttgttattaagggtaacactgaaattggcagtgaatgttacattacaagcggctcaagaattattgattcaaagatcggtaacaatgttactgtaacttcttcaaccattgaaaaatcagaaatggaagataatactgatatcggtcctaattcacaccttcgtccaaaggctcttattaagaagggagcacatattggtaacttcgttgaagttaagaaggctgaaattggtgaaaatactaaggttggacacttaacttatgttggggatgcaactttgggtaaggatattaatatcggttgtggtactattttctctaactatgatggtgttaagaagttccatactaatgttggtgatcatgcatttatcggtgctggttcaactttgattgccccaattaatgtagctgatcatgcatttatcgcagctgactctactattactaaggatgtagacaaatacgacatggcaattgctcgtggacgtcaagttaataagcctgattactggcataaattaccactttcaaaaaatgaagat

SEQ ID NO: 122 - protein, 459 aa, Lactobacillus acidophilus
MEKYVVVLAAGKGTRMKSKLYKVLHKVCGKTMVEHVVDAASGVEPTEIVTVVGTGAGDVEKVLADKSKFVFQEKQLGTGDAVMTAKEVLGDKDGATLVVTGDTPLFTTDTFNELFKYHTEKGNAATVLTAEAPNPFGYGRIIRDEQGNVLRIVEQKDGNPEELKVKEINTGVFCFDNKKLFEALKHVDNNNAQGEYYLTDVLEILRNSGENVGAYKMPDFSESLGVNDRIALAQATKIMQRRINEEHMRNGVSFIDPDTAYIDADVKIGNDTVIEGNVVIKGNTEIGSECYITSGSRIIDSKIGNNVTVTSSTIEKSEMEDNTDIGPNSHLRPKALIKKGAHIGNFVEVKKAEIGENTKVGHLTYVGDATLGKDINIGCGTIFSNYDGVKKFHTNVGDHAFIGAGSTLIAPINVADHAFIAADSTITKDVDKYDMAIARGRQVNKPDYWHKLPLSKNED

SEQ ID NO: 123 - DNA, 732 bp, Lactobacillus acidophilus
  misc_feature (0)...(0): ORF 1266 - undecaprenyl pyrophosphate synthetase
  CDS (1)...(732)
atgagtaaaaaagacaatgaattaaatcatttagccattatcatggatggtaatggtcgttgggctaaaaagagacataaaccaagatttgttggtcaccgtgaaggtatggataacgttgaacgaattactttagctgctaaccaactaggaattaaagtcttgactctatatgcattttcaactgaaaattgggctcgtcctaaagaggaggttgcatatttaatgaatcttcccgtacgtttttttgataaatatatgccaactttaatggaaaataatgttaaagttaacattatggggtatttagatgaattaccggaaaaaacgtataaaattgttcaacgtgctatgtctgaaacggtaaataatactggtttaattcttaattttgcttttaattatggttctagacgagaaataacttctgctgtaaaagaattgggtggaatgattgaatctggatctttaaagagtgaagagatcacagaaagtatgatttcagatcatttgatgactgggaattttggaaaatatcgagatcctgacttattaattagaacttctggtgaacaaagaatttctaatttcttgctttggcaattagcatattcagaacttgcttttagcgaaaaaaattggccagattttgataaagatgatttgaaagaatttgtagatgaatataagcaccgtaatcggcgcttcggtaaagtagacgaatcggatagt

SEQ ID NO: 124 - protein, 244 aa, Lactobacillus acidophilus
MSKKDNELNHLAIIMDGNGRWAKKRHKPRFVGHREGMDNVERITLAANQLGIKVLTLYAFSTENWARPKEEVAYLMNLPVRFFDKYMPTLMENNVKVNIMGYLDELPEKTYKIVQRAMSETVNNTGLILNFAFNYGSRREITSAVKELGGMIESGSLKSEEITESMISDHLMTGNFGKYRDPDLLIRTSGEQRISNFLLWQLAYSELAFSEKNWPDFDKDDLKEFVDEYKHRNRRFGKVDESDS

SEQ ID NO: 125 - DNA, 1167 bp, Lactobacillus acidophilus
  misc_feature (0)...(0): ORF 668 - undecaprenyl-phosphate N-acetyl-glucosaminyltransferase
  CDS (1)...(1167)
atgtttaaaattattgttgaattattcttattagtaattatttcagctgcaattacgccatttattaggcgtttagcctttgtgttaggagcggttgataatcctaatgctcgtcgtgttaataagaaaccaatgccaactattgggggattaggtatttttgttacgtttaacatcggtgcatttgtattactgagagaacaatttcctactcatgaaattttttcgatattattagcatcaagtgtcgttgtattaacgggattaattgatgatattcttgaactgaaacctaggcaaaaaatgtttggtatttttattgcttcattaattatttacttcttagcaggaattagaatgaatgtattaaaattaccatttattaccaatgagattaacttaggttggtggagttttccaattactattttttggatattagctttgactaatgcagttaatttaattgatggcctagatggtttagctgatggtgtatctatgatatctttaacgactatggggatcgtgggatatttctttttacatacgcatcaattgtatgtgccaattgcctgttttatgttagcagcatgtttattaggttttttgccatataatttccatcctgccaagattttcttgggtgacacaggtgcactttatattgggtttatgattgcggttttgtctttaaaaggactgaaaaacgtaactttcatttcattgttagtgccaataattattttaggggtgccaataactgatacagtttatgcaatgattcgtaggaaattgaacaaaaaaccgatttcagaagctgataaacatcacttacatcaccaattaatgcgaatgggactaactcatagacaaacagttttaacaatctatgcactctcattagttttttcattcatttcacttttatttttactatcaccagcttggggaacttggcttttgattcttggtttactggttgcacttgaatatttcgtggaatcgattggtcttttaggtgagaaatatcatcctttaatgcatatcattcaaaaagttattaatcaaaagagtaaaattgatccaacagtcgaggtttggcatttaggtgatgaaaagccagatcaattgaaagcagaaaaggatagaaaaaattataaaaag

SEQ ID NO: 126 - protein, 389 aa, Lactobacillus acidophilus
MFKIIVELFLLVIISAAITPFIRRLAFVLGAVDNPNARRVNKKPMPTIGGLGIFVTFNIGAFVLLREQFPTHEIFSILLASSVVVLTGLIDDILELKPRQKMFGIFIASLIIYFLAGIRMNVLKLPFITNEINLGWWSFPITIFWILALTNAVNLIDGLDGLADGVSMISLTTMGIVGYFFLHTHQLYVPIACFMLAACLLGFLPYNFHPAKIFLGDTGALYIGFMIAVLSLKGLKNVTFISLLVPIIILGVPITDTVYAMIRRKLNKKPISEADKHHLHHQLMRMGLTHRQTVLTIYALSLVFSFISLLFLLSPAWGTWLLILGLLVALEYFVESIGLLGEKYHPLMHIIQKVINQKSKIDPTVEVWHLGDEKPDQLKAEKDRKNYKK

SEQ ID NO: 127 - DNA, 939 bp, Lactobacillus acidophilus
  misc_feature (0)...(0): ORF 1922 - penicillin binding protein
  CDS (1)...(939)
gtgcgacgggctattaatagattaggtgttaaaggctctgtattggtaacaagtaatatgaagcctgtgctaaactatgcaacaaataatagtactgacactagctatttaataaattctgttcaaaaatcaatgaccgctgcaatggtaatgcgtgaggtgcaaaaaggtaagcttagcttagattataagctttctaagtattatcctaacgtagacggagctgattcagtcaaaattagtaatttgcttgatatgacttcgggtcttgatttacagcaaggtcaagaattaggtacaaaagaatttatttctgatgaaaagaacattgaacatgatcagaaatacacgatatttgatgcacaaaatcttggtaaatggcactatacttcagttaactacatttatctctgcggtatcttatctaagcttgagcacaagacttatgagcaattatttcatgagacttatatcaagccacttggcttaaagcaaacggaattcctttggtcagatatgtctaaactgcgtgccgttaactgggtaccaggatatgagatgaaggaaggtcagtacgttaaagtaaaacatgatgctgcagtgaaagatgcacataatgagttaggtgctggatcagttgtaatgtctaatggtgatttggctaaaacaattgaatatattttgcatggtaacatgctaaccaaacaaagtaagcagatcctctttaaggggaaggctcctacattctataatggtggattgtataaccttaagaattacaaatctgctaatggtgcaggtgaagggtattatacttttatgcgtactactaaggatgggaagaatatgattattattcaggataatcacaccgttcctggtgagtttggtaaggttaagaagaaagtgaaccgcatcatgtcaatgatgatgaacttt

SEQ ID NO: 128 - protein, 313 aa, Lactobacillus acidophilus
MRRAINRLGVKGSVLVTSNMKPVLNYATNNSTDTSYLINSVQKSMTAAMVMREVQKGKLSLDYKLSKYYPNVDGADSVKISNLLDMTSGLDLQQGQELGTKEFISDEKNIEHDQKYTIFDAQNLGKWHYTSVNYIYLCGILSKLEHKTYEQLFHETYIKPLGLKQTEFLWSDMSKLRAVNWVPGYEMKEGQYVKVKHDAAVKDAHNELGAGSVVMSNGDLAKTIEYILHGNMLTKQSKQILFKGKAPTFYNGGLYNLKNYKSANGAGEGYYTFMRTTKDGKNMIIIQDNHTVPGEFGKVKKKVNRIMSMMMNF

SEQ ID NO: 129 - DNA, 1122 bp, Lactobacillus acidophilus
  misc_feature (0)...(0): ORF 59 - penicillin binding protein (pbpX)
  CDS (1)...(1122)
ttgaagaaattacttatcaaacttgcagctgctagtcttttatcagcaacagtaccaacaatgattgctccaaccgcaacggttcatgcaagttcatattccagaactgagatgcgtaattttgtacgtaatgtttttgcacaaaataatagtcgcggtagcgcggtaattattaaggatggtcaaccgcaacaaattagttacggttgggcctggtatggtaaaaagatcggcaatggtaatgaacgcgtagtttatcctacaggttctttacaaaaagttattactgccgcaattattattcaattaatgaatgaaaatttgcatactaaccaacgcttttcacaatatacaaaaatttcgcgttggtatcctaatctaaaaaatgccgataatattaccttaggtcaactgatgacacacacttcaggtatcaatgcagttaacactgaaattgatcgtaatattaattattcagaagacgatgcaatcaactgggcaattgataatgtgaacaacactagcacaggcaccccaggaacatacttttacaataatacgaactacattttgcttgcaggaattatcaaaaaaattagtggccaatcctatgaagagaattttaacaatcgaattgttaacaaacttggtttagccaatacattcctttatcaaaacatccctagctggaagacagatccaatttcttatatatggaacaatggcaaaaactatcaagaacctgaatatgtttcaagatcattagcctctcaactaccgggtgcggggaacatgttcaccacaccaattgattattacaaaattcagcttggtttaactaatggaagtattttaagtcgagaggactttaggtatcttactcatttaaaaaatagagtaaatgattactctggtggtctatatcttgataataatgacactattaaatctgcttatggaaatttaacaaatactcactttggtgcatggattcaaatgacggctgataaccgcaatgggttaatcatgtttttaaaccaaacatcaggcgatgaaaatgcccaaaagcaaatgggatatcaaattttaaatcatattaagccatatacattccttagtaga

SEQ ID NO: 130 - protein, 374 aa, Lactobacillus acidophilus
MKKLLIKLAAASLLSATVPTMIAPTATVHASSYSRTEMRNFVRNVFAQNNSRGSAVIIKDGQPQQISYGWAWYGKKIGNGNERVVYPTGSLQKVITAAIIIQLMNENLHTNQRFSQYTKISRWYPNLKNADNITLGQLMTHTSGINAVNTEIDRNINYSEDDAINWAIDNVNNTSTGTPGTYFYNNTNYILLAGIIKKISGQSYEENFNNRIVNKLGLANTFLYQNIPSWKTDPISYIWNNGKNYQEPEYVSRSLASQLPGAGNMFTTPIDYYKIQLGLTNGSILSREDFRYLTHLKNRVNDYSGGLYLDNNDTIKSAYGNLTNTHFGAWIQMTADNRNGLIMFLNQTSGDENAQKQMGYQILNHIKPYTFLSR

SEQ ID NO: 131 - DNA, 2106 bp, Lactobacillus acidophilus
  misc_feature (0)...(0): ORF 1509 - penicillin binding protein
  CDS (1)...(2106)
gtggactattttagaaaaaacagtgggactggttcaaataaacagtcctcaacaccaataagaatgcgaatcattctgggtgtgatcctcgtactttttgcgatgctgatagggcagcttgcatatttgcaactggtttatggttctcgctttaaagccgaggtacagcagtctgattccacagttgtatcaaatcaagtgcctcgtggtgtaatgtatgacgccaagggacgagtattagtaggtaataaagcaactaatgcgattacttatactaaaagtgcatcgactacgacggcgcaaatttaccaaatttcgaacgctttgagtaattatatcaagattactgatgaaaagccgacaaagcaaatgacggctgattactacttagcagatgaaaagaataataccaaaatagaatcattattgcctaaatcagctaaggttgatgctggcggcaataagaagactaattctgaagtttatcaagctgaattagcgtatgttgaaaaaatgaatcctaagctgactgaaaaacagaaaacagcagctttgatcttcaataagatttcaggagcctacactttatcaactatttatattaaaaataaaggtttaacggatagagaaattgctcaagtaggtgaacacttgtcagaacttccaggtgtaggtatcggaactgactggcaaagatcatatccaaatggttcatcaattcaaagtattatcggttcagtttcaactgaaaaatctggtttgcctagcgataacttacagtactatttaagaaatggttactctagaaatgatcgtgttggtacgtcatatctagaagaagaatatgaaccgcttttaaaaggtacgaagtcaactagtcaggtaactactaaatcaaatggtaatattcaacaaaccaagactgtttataacggtcaagctggtgcaagtttgatgttaactattgatgccaagtatcaaaaacaagttcaagctgctttaaagcgtgtttatagttctgctgaagcggcaggtgctgcacgatattccaatggtgcgtatgctgtagcaatgaatcctcaaactggtgcgcttctcgctgttgccggtattaatagaaatactaatactggtaaaactacggataatgcgttaggcgtaattaaccaatcatttgttatggggtccgttgttaaaggagcgactgtatcgggtggtttaattaataaagtaattacaccaacaaataatactttacctgatacgccaatttacttgccaggttctccagttaagaaatcagtttacccagtaggtactttcagttctcttgatgcagaaaccgctttggaagtttccagtaacatttacatgatgcacttagctatgaattgggttggtgctaagtatgtgcctaagacttatattcatatgcccaataattcatttgacattttacgtcgtaactttgcaatgtttgggttaggacaaaagactggtgttgacttaccaggtgaagtttcaggtattcagggtaagtcatttaactctaaaggtaatattttatcaggttctgtacttgacttggcctatggtaactatgatgcatatacgccaattcaacttgcgcaatatgtatcaactattgctaatggcggctacagaatgcagccatatattgtgcaatctgtaggtaagacaagcaaagatggtaaaaagatctatattaattacaataaaaagccaaatgttcaacaatccattccatggactccagatgagcttaacgttgtaagacaagggttttaccgtgtagttcacggtactaacggttggggtactgctcacccactgaagaatgttaaaccttcaatttcaggtaagaccggtactgctcaaactttctattacgatgcagaacatcctaatagaaagcacaacattgaattaatcaatgcaactttcatcggttatgctccatctaataatccaaaattagcaatcgcagttgtattcccaggacttgatcctgatggtgaaggtacatatactttacaggttgctaaagcaatggttcaagattatttcaagcttcattccacaaaa

SEQ ID NO: 132 - protein, 702 aa, Lactobacillus acidophilus
MDYFRKNSGTGSNKQSSTPIRMRIILGVILVLFAMLIGQLAYLQLVYGSRFKAEVQQSDSTVVSNQVPRGVMYDAKGRVLVGNKATNAITYTKSASTTTAQIYQISNALSNYIKITDEKPTKQMTADYYLADEKNNTKIESLLPKSAKVDAGGNKKTNSEVYQAELAYVEKMNPKLTEKQKTAALIFNKISGAYTLSTIYIKNKGLTDREIAQVGEHLSELPGVGIGTDWQRSYPNGSSIQSIIGSVSTEKSGLPSDNLQYYLRNGYSRNDRVGTSYLEEEYEPLLKGTKSTSQVTTKSNGNIQQTKTVYNGQAGASLMLTIDAKYQKQVQAALKRVYSSAEAAGAARYSNGAYAVAMNPQTGALLAVAGINRNTNTGKTTDNALGVINQSFVMGSVVKGATVSGGLINKVITPTNNTLPDTPIYLPGSPVKKSVYPVGTFSSLDAETALEVSSNIYMMHLAMNWVGAKYVPKTYIHMPNNSFDILRRNFAMFGLGQKTGVDLPGEVSGIQGKSFNSKGNILSGSVLDLAYGNYDAYTPIQLAQYVSTIANGGYRMQPYIVQSVGKTSKDGKKIYINYNKKPNVQQSIPWTPDELNVVRQGFYRVVHGTNGWGTAHPLKNVKPSISGKTGTAQTFYYDAEHPNRKHNIELINATFIGYAPSNNPKLAIAVVFPGLDPDGEGTYTLQVAKAMVQDYFKLHSTK

SEQ ID NO: 133 - DNA, 2112 bp, Lactobacillus acidophilus
  misc_feature (0)...(0): ORF 1593 - penicillin binding protein
  CDS (1)...(2112)
atgtgttttagcaactatgatacaattttcttgtttctaaaaaggagcatgtatttaatgaataatgaccaaccaagaagaagtagttttaaagatgcttggcatcgatttgataaccgcttctttatcggacgctggattattttaatcctgcttattcttatgcttttaacttgtacatattatacaatcaaagttaaaacttcgaatatctcgaatttaaaagcatcattatcaacaacaacaaccatttatgattacaagggtaaaaaagctggttctttgtattcacaaaagggatcgtttgttgaatatgacaaaatttcgccaaatattcaaaatgccgtgatttcgacagaagatcgtactttctggaaaaaccccggctttagcgttaaaggaatggcccgtgctgccattagtttaattattcatcatggtcaagttaccggtggtggatcgacgttaacacagcagttagctaagaattcgcttcttacgcagcagcaaactttttcgcggaaattagaggaactattttttgcaattgaaatcaatcatgtttactctaaaaaagatattttgacaatgtatttgaacaatgcctacttcggaaatggggtatggggtgttcaagacgctagtcgtagatattttggtaaagatgctagtgaagtaactgtcagtgaagccgcaacacttgctgcaattttgcgtaatccaagttattataatccagttgaccatatggctaatgcattatcacgtcgaaacctagttttaagtttaatggctgataatggcaaaataactgctgctcaagctaaagcttattctaaagaaggattaactttaagaaacacttttaaaaacaaagatggctatcgctatccttacttctttgatgctgtagttgatgaggcaattaacaaatatggtttaactgaagaacaggtaatgaataagggattaaagatttacactactcttaatcaaaattaccaaggacaattacaaaatacctttgagcaaagttggctgtttccacaagcgggaagcgatggtgttgaatgtcaaggtgctagtgtggcaatggatccaggtactggagcggttcgtgcagtaattggtggacgtggtcaacatgtctttcgtggttataaccgtgcaacacaaatgaaacgtcagccgggttcttcaattaagccgatagcagtatatgcgccagctcttcaaaatggctatcattatgattcagagctatcaaataaattgcaaaaatttggtaagaatgggtacgaaccacataacgttgacaacggctattctgataaaatcccaatgtaccaagccttggctcaaagtaaaaatgtgccagcagtttggttattagataaaattggtgtaaataaaggggttcaatctgttgaaaactttggtattaaagtaccgaaaagtgatcgtaaccttgctttggccttaggtggtctttcaagtggtgtatcaccattgcaaatggctcgagcttattctgcttttgccaataagggtaacttaccaaataactcatactttattactaagattacagatgcaagtggtaatgttttggcagaaaacaataatctaggtacccatagagttatttcagagaatacagcaaaagaaatgactacgatgatgcttggggtgtttactaatggtacaggtcagtctgctcaacctaatggttataaagtagctggtaaaactggatcaacggaagtacctaattcatatggtttcggtaccaaagatcaatggattgtcgggtatacaccagatattgttttagctacttgggtcggctttgatcgtactaaccggcaacattatatgcaaggtatctctgaaacaggaattactaggttgtataaagcagaaatggaaggaatcttgccatatactgcacaaacgcaatttactgaaaaagcacctagccaaattataaagaataatggttcaaattctgattggactggtggattaggacaaaaaattcaagatggtataggttctgcgggacagacaattaatgaatggtataatagtctgaaagggctattaggccga

SEQ ID NO: 134 - protein, 704 aa, Lactobacillus acidophilus
MCFSNYDTIFLFLKRSMYLMNNDQPRRSSFKDAWHRFDNRFFIGRWIILILLILMLLTCTYYTIKVKTSNISNLKASLSTTTTIYDYKGKKAGSLYSQKGSFVEYDKISPNIQNAVISTEDRTFWKNPGFSVKGMARAAISLIIHHGQVTGGGSTLTQQLAKNSLLTQQQTFSRKLEELFFAIEINHVYSKKDILTMYLNNAYFGNGVWGVQDASRRYFGKDASEVTVSEAATLAAILRNPSYYNPVDHMANALSRRNLVLSLMADNGKITAAQAKAYSKEGLTLRNTFKNKDGYRYPYFFDAVVDEAINKYGLTEEQVMNKGLKIYTTLNQNYQGQLQNTFEQSWLFPQAGSDGVECQGASVAMDPGTGAVRAVIGGRGQHVFRGYNRATQMKRQPGSSIKPIAVYAPALQNGYHYDSELSNKLQKFGKNGYEPHNVDNGYSDKIPMYQALAQSKNVPAVWLLDKIGVNKGVQSVENFGIKVPKSDRNLALALGGLSSGVSPLQMARAYSAFANKGNLPNNSYFITKITDASGNVLAENNNLGTHRVISENTAKEMTTMMLGVFTNGTGQSAQPNGYKVAGKTGSTEVPNSYGFGTKDQWIVGYTPDIVLATWVGFDRTNRQHYMQGISETGITRLYKAEMEGILPYTAQTQFTEKAPSQIIKNNGSNSDWTGGLGQKIQDGIGSAGQTINEWYNSLKGLLGR

SEQ ID NO: 135 - DNA, 1029 bp, Lactobacillus acidophilus
  misc_feature (0)...(0): ORF 1605 - penicillin binding protein
  CDS (1)...(1029)
atgcatttaaaaaaatctatcctgtccatctttttaacactatgcatttttttgttgtttattttaatatcagtgaacagagtggatgttggcgatatagctttatcaaaacaacttcatgattatatgcaattacatcatattaatggtgtaatgttggtcaatgataaaaaaggtaaaccaattataattgaaaatagagagacttctaataaaggccaaatagtagatgaaaatcaattatttccgattgcttctcttcaaaagattatgacagggactgcaatttatcaattacatcaaaaaaagcagataaattggaatacttctttggctaaatattttcctcaaatcccgggtagtaaagatataacaattcgtgaattgatgaatcatacgagtggattaattaataatgatcgtccaacatccccattaagaaatgaaaaacaacagattaattatatgcttaaacatataaaatatgatcatattcatacttgggactatcaagatatagattatgaattattagcagcaattattagtaaacaaactaacacaacctataatacttatattaaaaataattttgtcaagtctgctaatctccataaaattaaagatttttcagaagttgatcaaagagaagttcctcaacctatgaataaaaagatcagttggcatgaagttacagtaacaacatcatctgattttggagctggaaacttgtttatttcacctaacgattattggaaatttgtaaataatggtgttttaaataatcatcaaatgataaatgaatattatcatcaggcacaacatcaagaagttgcttattttggtggtgtttattttaaaggcgatattattcgtgcagaagggagtattcctggatataattcctgctttgtagctaactatagaactaagaaaatgattatgcttttttctaataatattaattattttactttgaaaatggcatctgatcatattttgcataaatacatagagaaacacattatt

SEQ ID NO: 136 - protein, 343 aa, Lactobacillus acidophilus
MHLKKSILSIFLTLCIFLLFILISVNRVDVGDIALSKQLHDYMQLHHINGVMLVNDKKGKPIIIENRETSNKGQIVDENQLFPIASLQKIMTGTAIYQLHQKKQINWNTSLAKYFPQIPGSKDITIRELMNHTSGLINNDRPTSPLRNEKQQINYMLKHIKYDHIHTWDYQDIDYELLAAIISKQTNTTYNTYIKNNFVKSANLHKIKDFSEVDQREVPQPMNKKISWHEVTVTTSSDFGAGNLFISPNDYWKFVNNGVLNNHQMINEYYHQAQHQEVAYFGGVYFKGDIIRAEGSIPGYNSCFVANYRTKKMIMLFSNNINYFTLKMASDHILHKYIEKHII

SEQ ID NO: 137 - DNA, 2328 bp, Lactobacillus acidophilus
  misc_feature (0)...(0): ORF 1159 - penicillin binding protein 1A (pbp1)
  CDS (1)...(2328)
atggcagataatacaaataatatgaaacgtgaatcacgacgaaactatcacggacgaaggtcgagtggtggccatttatggataaaaataataaaatggctatttcttgctgcactattagtggtagtttctggtattgggctttttgctttctatgcaaaggatgctcctaatattagtcaaagccaacttcaaagtggtggtacttctagcctttataccaatgatggtaaatttttattatcacttggatctgaaaaaagaatctacgttaagaataaagatattcctcgacagttaaaagacgcaattgtttctgttgaagataaaagattctacaaagatagacttggagtagatccaattagaattgtgggatcaatgcttactaatgctaagagtaatagtattgctgcaggtggatcaactattactcaacaattggttaagttaaccgtattttcaactgcggcttcacaacgtactttaaaaagaaaagcccaagaagcttggttagcaatgaaagtgcaacatgaatttagtaaagaccaaattttagaattctatgttaataaagtctttatgaattatggtaattacggtatgggaacagccgctaattattattacaataaatctctaaaggatctcgatttagcacaaactgctttaattgcagggatgcctaatgctcctgtaatgtatgatccatatttataccctcaaaaagctcgctatcgtagaaatatcgttttaaagacaatgcttgaaaatgataagattacgaaggctcaatataatcaagcaattaatgaacctattaccaaaggattacgccctagacacactaataatgaatctaagattagacaaatcgatgatccatatattaaggaggtaatttctgaagttaaaagtaaaggttttgatccatataatgataatttgaagattacaataaatattgatcaaaaagctcaaaacaagttatatcaattagcgaacaatggtgaagtaccatttactaatgacaaaatgcagattggtgcaactgtagttgatcctaataatggtcatgtagtagcaattttaggtggtcgacatttaccttctgttcaattaggtcttgatcgtgcagttcaaactggtcgttctaccggatcgtcaattaaacctgttcttgattatgcaccagcgattcaatatttgaattggtcaacagctaaaatgttagatgatagtaaatatgtttatccaggaaccaatattcaattatatgattgggataacaaatatgatggcatgatgacaatgcgtaaagcattggaacaatcacgtaacgttccagcagttaaaacccttgctgatgtaggagtaaaacgtgcttccgcatttgctagacgtatgggtgtagatgttcctgcaaattcaggcttatcagtggcaattggtgctaatgcatcaagtttacaaatggctggtgcatacagtgcatttgctaccatgggtgtttatcataaaccacaatttgtatctaaaattgaaactccagatggtttaactagaaattatgattcaaatggtgtgcgtgtaatgaagaaatctaccgcatatatgattactgatatgttaaaaggagttattaaaagaggttctggtacaaacgctaaaatagctgacctttatcaagctggtaaaacaggtactgttaaatactccgatgaagatttagccaagtatccaggctataattcaactcctaaggattcatggtttgtaggttatactagatcgtatgttatgggtgtgtggacaggatatgataatctaaaagatggtactatctctggaattggtcagcaatctgctcaattaatttataagagtatgatgacctacttaatgagaaataagcctaatttggattgcaaacaacctaattcagtagttagagcaagaattgttaataattctaatcctccagaagttgctactagtggcggaacttggcaattgtttgttcgtgggcatgctcctgcaggtatcggaaatagtgctgcaagttatgatgaagaagatgaagaaacagatactactagtaacaatactgataacactacctcatccagttcttcagtaaccgtagagagtcgtgtttcttctagaagagaaaatggtactactactcaatcaagtagcagtcaaagagtctcttcttcaagtgaaagtcgagagcaatcttcatcgcgtgaacaaagtagcagtgaacagcaatctagacccgataatacagaacgagatcaggaaaatactgatagaaataatgat

SEQ ID NO: 138 - protein, 776 aa, Lactobacillus acidophilus
MADNTNNMKRESRRNYHGRRSSGGHLWIKIIKWLFLAALLVVVSGIGLFAFYAKDAPNISQSQLQSGGTSSLYTNDGKFLLSLGSEKRIYVKNKDIPRQLKDAIVSVEDKRFYKDRLGVDPIRIVGSMLTNAKSNSIAAGGSTITQQLVKLTVFSTAASQRTLKRKAQEAWLAMKVQHEFSKDQILEFYVNKVFMNYGNYGMGTAANYYYNKSLKDLDLAQTALIAGMPNAPVMYDPYLYPQKARYRRNIVLKTMLENDKITKAQYNQAINEPITKGLRPRHTNNESKIRQIDDPYIKEVISEVKSKGFDPYNDNLKITINIDQKAQNKLYQLANNGEVPFTNDKMQIGATVVDPNNGHVVAILGGRHLPSVQLGLDRAVQTGRSTGSSIKPVLDYAPAIQYLNWSTAKMLDDSKYVYPGTNIQLYDWDNKYDGMMTMRKALEQSRNVPAVKTLADVGVKRASAFARRMGVDVPANSGLSVAIGANASSLQMAGAYSAFATMGVYHKPQFVSKIETPDGLTRNYDSNGVRVMKKSTAYMITDMLKGVIKRGSGTNAKIADLYQAGKTGTVKYSDEDLAKYPGYNSTPKDSWFVGYTRSYVMGVWTGYDNLKDGTISGIGQQSAQLIYKSMMTYLMRNKPNLDCKQPNSVVRARIVNNSNPPEVATSGGTWQLFVRGHAPAGIGNSAASYDEEDEETDTTSNNTDNTTSSSSSVTVESRVSSRRENGTTTQSSSSQRVSSSSESREQSSSREQSSSEQQSRPDNTERDQENTDRNND

SEQ ID NO: 139 - DNA, 654 bp, Lactobacillus acidophilus
  misc_feature (0)...(0): ORF 1158 - penicillin binding protein related factor A
  CDS (1)...(654)
atgctaacaggagtgaggttaatggtcaaatatccaagcggtagtttagccgcatttagaaaaccagtgacaacacaaaaaaagatgcgcactggtaaacgttcatatacacataaaaaaggcgttaacttttctgatcgtggtatgacacttgaacaacagattaatgaatctaataaatattatttaactgaagaaattgcagtagttcataaaaaaccaacgccaattcaaatcgtaaaggttgattaccctaagcgatctaaagcagttattcgtgaagcttatttcagacaagcttctacaactgattataatggcgtttataagggatattatcttgactttgaagcaaaagaaacaaagaataagacaaacttcccgttaaaaaattttcatgaacatcaaatttttcatttagctgaatgcttaaagcaacaggggatttgttttacgattattagatttgctagcttggagcgatattttgttacaccagctagttttgtaattaatgcttggagaaaagcagaaaaaagttctatgactttaaaagagattgaaagccattcttatgagatcaaaagcggttttcgacctaccctaccttatcttaaggcagtggataattttattgcagataggaaaagagaa

SEQ ID NO: 140 - protein, 218 aa, Lactobacillus acidophilus
MLTGVRLMVKYPSGSLAAFRKPVTTQKKMRTGKRSYTHKKGVNFSDRGMTLEQQINESNKYYLTEEIAVVHKKPTPIQIVKVDYPKRSKAVIREAYFRQASTTDYNGVYKGYYLDFEAKETKNKTNFPLKNFHEHQIFHLAECLKQQGICFTIIRFASLERYFVTPASFVINAWRKAEKSSMTLKEIESHSYEIKSGFRPTLPYLKAVDNFIADRKRE

SEQ ID NO: 141 - DNA, 1092 bp, Lactobacillus acidophilus
  misc_feature (0)...(0): ORF 1006 - penicillin binding protein
  CDS (1)...(1092)
atgaaagcagcagcttcattgacagtaattgcttcattgccaatgggagttttggcaaataccaaaactgtacatgctgcatatgatcaaagtgaaatgcgtagttttgttagaagaacaatagctaattattatgcccgtgggactaccgtcattattaaagatggtcatgctcaacaaattagttatggttatggctattacggtaaaaggttaggtgctggtaatagcaaggttgtttatccagtatgttctttgcaaaaagtgattacaggagctattatcacccaattgatttatgcaggaaagtttaatcaagatactaagatttcaacatggtatcctaacctaaaaggtgcatccaatattactgtaggaaacttgatgacacacacttctggattgaaagcagccgatactgaagttaatcgtagacgtatgtattctgaagaggacgctattaattgggttgttgatcgattaaatgaaacctcccaaaataatccaggtaatttttcatataataataccaattatattttgttagcggggattatccgtaaagtaacgggtcaatcttataagcaaaatgttcaagaaagaattattagtcctcttaatttgaagcggacatatttcttagaagatattcctgcgggtatgactgatggtatttcgtatacctggaatgctaagaattatcaatgggcgcaatatgtaaaaaaacaacaagcttcccaattagtaggtgctggcaatttattctcaacaccaatggattattaccgaattcaagttggcttaactaatggtaaaattttaaatcaagctgaattcaactatatgactcatttgagttcaagatccagcaatgggtattccggtgggttatatatgaaaaataatgataatttaaaattagcatatggtaacttgtataacacccactttggtaattggattcaaatgacttctgataataggaatggtttgattatgttcttaaatcagactcaaaatgatgaagctagaaataagactattggttatcaaattttaaatcatattcaacctaatacatttagtgcaaaa

SEQ ID NO: 142 - protein, 364 aa, Lactobacillus acidophilus
MKAAASLTVIASLPMGVLANTKTVHAAYDQSEMRSFVRRTIANYYARGTTVIIKDGHAQQISYGYGYYGKRLGAGNSKVVYPVCSLQKVITGAIITQLIYAGKFNQDTKISTWYPNLKGASNITVGNLMTHTSGLKAADTEVNRRRMYSEEDAINWVVDRLNETSQNNPGNFSYNNTNYILLAGIIRKVTGQSYKQNVQERIISPLNLKRTYFLEDIPAGMTDGISYTWNAKNYQWAQYVKKQQASQLVGAGNLFSTPMDYYRIQVGLTNGKILNQAEFNYMTHLSSRSSNGYSGGLYMKNNDNLKLAYGNLYNTHFGNWIQMTSDNRNGLIMFLNQTQNDEARNKTIGYQILNHIQPNTFSAK

SEQ ID NO: 143 - DNA, 1107 bp, Lactobacillus acidophilus
  misc_feature (0)...(0): ORF 858 - penicillin binding protein (fmt)
  CDS (1)...(1107)
ttgaaacaaactaaaaaattctggttattattaattttgttagtgtctacattggggatggcattagaacaaacgcaaacagtaaatgctaaggtctattctaatagtcaattacgtaaatatgtaagaaaaaccctaagaaagcatcatttgcgtggaagcgtggtagtagtcaaaaatggacatagtcaacaaataagtgagggttatggctattatagacgtagaatcaaaaatgggagtaaaaagttagtatatccaaccggttctttgcaaaaatcgataactgctgccattattgctcaattaatctatcaaaataaattttcacaaaatactaaaatttcaaaatggtatgccaatttaagaaatgcttctaaaattagcgtagggcaattaatgacgcatacttcagggattggtttcagtgggactgaatctaataatggcgttaatttttctgaaaatggcgcagttaattgggcagtagcaagagtaaatgcacaagaaaataccggtatcaatagttttaactataataatgccaattacattttattagctgggattatccgcaaatctactggtaaatcatatgctactaatgtaaaagaacgcataattaagccattacatttgaaacatacttatatttataacaatattcctcgttctcaaacggatgctatttcatatctttaccgttatggcaaaaattatgaagcagctgcatatgcaaataaaaatgtagtttctcaattgcctggtgcagggaatctgttttctacaccagctgattatttaaaaattcaacgcagtttatataatgggaaaattttaactgctaagcaattctcgtatttagctcatttaaaatcaaaggttaatacttattcaggtggtttttacttgaaaaaaagtggtactttgaaattggcatatggtaattttggagatacccattttgttaattggatgcaattgactaaaaataataaaaatggaattgtgatgtttcttaaccaaacttatggtactaagaatcaaattaagagtgttggttataatattttgaaacatattaaatctaacacctttataaaagga

SEQ ID NO: 144 - protein, 369 aa, Lactobacillus acidophilus
MKQTKKFWLLLILLVSTLGMALEQTQTVNAKVYSNSQLRKYVRKTLRKHHLRGSVVVVKNGHSQQISEGYGYYRRRIKNGSKKLVYPTGSLQKSITAAIIAQLIYQNKFSQNTKISKWYANLRNASKISVGQLMTHTSGIGFSGTESNNGVNFSENGAVNWAVARVNAQENTGINSFNYNNANYILLAGIIRKSTGKSYATNVKERIIKPLHLKHTYIYNNIPRSQTDAISYLYRYGKNYEAAAYANKNVVSQLPGAGNLFSTPADYLKIQRSLYNGKILTAKQFSYLAHLKSKVNTYSGGFYLKKSGTLKLAYGNFGDTHFVNWMQLTKNNKNGIVMFLNQTYGTKNQIKSVGYNILKHIKSNTFIKG

SEQ ID NO: 145 - DNA, 2160 bp, Lactobacillus acidophilus
  misc_feature (0)...(0): ORF 805 - penicillin binding protein (pbp-2B)
  CDS (1)...(2160)
atgaaaaaaaacagtaatttaaaattacaaaaatccaaagcccacagctaccgcttcacagtagggagatttctccaagtagctgtcgctttggtttttcttgtatttacggctagatttttatatataggtatatctaaaacggttaatggacaaaatttgtccgctagaacacaacagctttataggcgaaatcaagttattaaggcaacgcgtggaactatttatgatagaaatggtttagccattgctgaagattcgcatttatatactatttatgcaattttggacaaatcctcgattaactataagaataaaccagaatatgttgttaataaaacagagacagcagaaaaactagcaacagtgttgccattatctgctgataaaatttatcaatatttaaatcccaagcataaagctttccaggttcaatttggaacaggtggtagtgggttaacaattaaacaaaagaagaaaattgaagcaatgaaattaccagggattaagtttttggctacaccatctcgtctataccctaatggtaattttgcttctcatattgttggcttagctcaacctgaatatgataaaaagaccaatgatgaaactttggttgggactatgggaattgaagcttatttcaataatacattgactggtacagatggttatcgaatttcttcagtagatgcatcggaatatcagatgcctaacggtaatcaagtttataaaccggttaaaaatggtaataacttgtacttgacacttgattcccaacttcaaagttatcttgaatcacgcttaactgaagttcaaaaggcttatgatccaacttcaataactgcagtagttgaggatatgaagacaggtaaaatattagctgcttcacagcgtccaacgtttaatccgcagactaaaaaaggtttgaccaaatcatatagaaatattttagttcaagatacatatgagccaggttctgtctttaaaatactatcgtttgctgctgtagtaaatagtggtaattataatccgaatgagtattatcgttcaggttcagtaaacgttgggggatctactattcacgattggttgacctctggttggggaactattccattttcacaagcctttgaacgttcaagtaatactgggtttgttaagttagaacaaaaaatgggttcgaaaacttggaagaaatatttgaataaattccatattggagaaaaaacaggtatcactcttcctggagaacaaccaggtttcatttcatttaaaaccccagtcgatcaagcggttactgcatttggccaaggcgtaaatgttaatgtaatgcagatgatgcaagcatatagttcattagcaaataatggtcaaatggtaaagccacaattggttgataaagttaccgattcagatggcaatatgattaaaggatacgaaattcaaaaagtagggtcacctatttatagcagtaaaactcgaaaagttgttttagctaacatgaaacgagttcttaacaaacagtcaggtactggtaatgcttataagatggggaatgcagatatcgctgtgaagaccggtacagcacaaattgccaatccaaaaggtggcggatatctcaaaggtgatagcaattatatcttctcagtggtcggcgtttacccagcaagtaatcctagatattgtgtttatctgacgattaaacagcctcatttagtaggtggtgctactgctgaaaagatcttagcatctatttttaagccaatgatgagtagaattatttctatggccaaaaatgatgatacttcaactactgttagtgtgccagactttaagaacttaacttatagccaagctctagctaaggcaaaacaagtgggactcaatttggttaaagttggcgacggtgacagaattaccgaacaaggccttaaaaagggcgaaaagttggaatcaggggataaaatatttgtatctacctctggaaaagttgtttgtcctaatatgaaaaattggagtataaatgatttgcatcaatttaccaatttgacagatgttaaatttagtataaagggaaccggaactgtttctagtcaaagtatagctgcaggaacagaattaaaagccggaaagaaaataaaagttaatttaaaggag

SEQ ID NO: 146 - protein, 720 aa, Lactobacillus acidophilus
MKKNSNLKLQKSKAHSYRFTVGRFLQVAVALVFLVFTARFLYIGISKTVNGQNLSARTQQLYRRNQVIKATRGTIYDRNGLAIAEDSHLYTIYAILDKSSINYKNKPEYVVNKTETAEKLATVLPLSADKIYQYLNPKHKAFQVQFGTGGSGLTIKQKKKIEAMKLPGIKFLATPSRLYPNGNFASHIVGLAQPEYDKKTNDETLVGTMGIEAYFNNTLTGTDGYRISSVDASEYQMPNGNQVYKPVKNGNNLYLTLDSQLQSYLESRLTEVQKAYDPTSITAVVEDMKTGKILAASQRPTFNPQTKKGLTKSYRNILVQDTYEPGSVFKILSFAAVVNSGNYNPNEYYRSGSVNVGGSTIHDWLTSGWGTIPFSQAFERSSNTGFVKLEQKMGSKTWKKYLNKFHIGEKTGITLPGEQPGFISFKTPVDQAVTAFGQGVNVNVMQMMQAYSSLANNGQMVKPQLVDKVTDSDGNMIKGYEIQKVGSPIYSSKTRKVVLANMKRVLNKQSGTGNAYKMGNADIAVKTGTAQIANPKGGGYLKGDSNYIFSVVGVYPASNPRYCVYLTIKQPHLVGGATAEKILASIFKPMMSRIISMAKNDDTSTTVSVPDFKNLTYSQALAKAKQVGLNLVKVGDGDRITEQGLKKGEKLESGDKIFVSTSGKVVCPNMKNWSINDLHQFTNLTDVKFSIKGTGTVSSQSIAAGTELKAGKKIKVNLKE

SEQ ID NO: 147 - DNA, 1512 bp, Lactobacillus acidophilus
  misc_feature (0)...(0): ORF 1926 - DltA D-alanine-D-alanyl carrier protein ligase
  CDS (1)...(1512)
atgattcaagatgttattaagagaattgacgagatagctgaaaatgaaccagatcgtgtagtttacgattatctcggtgaaaccaatacatatggtgaccttaagaagcgttcaaacgcttgggcacacaagattgctagtatggatatcccagaacatgcaccaatcatgatctggggtggtcaaacatttgaaatgattgctagtttcttaggttgtgttaaatcaggccacgcatatattccaattgcaagttattcaaatgctgaacgtttaacaatgattcaagatgtttcaaaatcacctatggttttggaaattgatccattgccagacgttaatttagacggcatcaaggtacttaaagctaatgaagttgaagatggcgactttacagttgatgaaagtaatttcgttgaaggcgacgaaaattactatattatctttacttcaggtactactggtaagccaaagggtgtacaaatcagtcatgataatttgttgagttttgtaaactgggaattatcagattttaatttgccagaacacccaagctttttggcacaagctccatactcatttgacttgtcagttatgagcctttatcctgcacttgtttcagcaggaaagcttgttgttttaccacatgatgttacgcaaaactttggtcaattgttccaaactttaccaaaaatgcaatttaatgtttgggtatcaactccatcatttgcacaaatgtgtttcttagataaaacctttgatgcagaacatcatccagacttaactcacttcttattctgtggtgaagaattaccacatagtgaagctgatatgcttaagaagaagttcccagaaagtcatatttttaatacttacggtcctactgaaactacagttgctgtgactcaagtagagatcactgatgaaatacttgaaaagtatgatcgtctaccaattggtagagtaaaagaagacactaagattactattgatacttcaaagggagataagcctggcgaaggtgaaatcattatcagtggtcctagcgtttcaaaagggtacatgaataaccctgaaaagaccgaagctgctttcttccaaaatgagggcgacaagtatcgcagctaccgtagtggagatgctggattctttgatggtgatatgctattttatcgcggtagaatcgacttccaaatcaagttcaatggttacagaatcgaacttgaagaaattaatttctacttgtcaaagaatgaatttgtacgttatggtgtcgcagcacctaaatacaataaagatcatactgtaaagcaaattgttgctgaaatcgaattgaagcatggcgttcgtcgtaagtattctgatgcacaacttactaagttgattcgtgaagacttagctaagaacgtgatgccttacatgattccacagcgttatgtttaccaagatacattaccaatttctcaaaacggtaaggtggatattaaggcagttattaaggaggttaataag

SEQ ID NO: 148 - protein, 504 aa, Lactobacillus acidophilus
MIQDVIKRIDEIAENEPDRVVYDYLGETNTYGDLKKRSNAWAHKIASMDIPEHAPIMIWGGQTFEMIASFLGCVKSGHAYIPIASYSNAERLTMIQDVSKSPMVLEIDPLPDVNLDGIKVLKANEVEDGDFTVDESNFVEGDENYYIIFTSGTTGKPKGVQISHDNLLSFVNWELSDFNLPEHPSFLAQAPYSFDLSVMSLYPALVSAGKLVVLPHDVTQNFGQLFQTLPKMQFNVWVSTPSFAQMCFLDKTFDAEHHPDLTHFLFCGEELPHSEADMLKKKFPESHIFNTYGPTETTVAVTQVEITDEILEKYDRLPIGRVKEDTKITIDTSKGDKPGEGEIIISGPSVSKGYMNNPEKTEAAFFQNEGDKYRSYRSGDAGFFDGDMLFYRGRIDFQIKFNGYRIELEEINFYLSKNEFVRYGVAAPKYNKDHTVKQIVAEIELKHGVRRKYSDAQLTKLIREDLAKNVMPYMIPQRYVYQDTLPISQNGKVDIKAVIKEVNK

SEQ ID NO: 149 - DNA, 1236 bp, Lactobacillus acidophilus
  misc_feature (0)...(0): ORF 1925 - DltB basic membrane protein
  CDS (1)...(1236)
gtgaattttaatttcattaacttacaaccttactcaaatccgcaatattttgtttacttgatgatcgcgttaattcctattattattggactttactatggtcatcgtctcaagacatatgaagcgattttctcaattgttttcttattcttgatttttgacggtagtcactggcaacaaggtgtaaacttgctaatctggctggtttatgaatttgctttgacgtttgcttatcagtattatcgtcatcatggtaaaaataagacttgggtatttagcttggctgtaattttagcgattattccgctggctgcagttaagtatttgaccgcattcccacttaattcaatcaactttgttattggatttttaggtatttcttacgtaactttcaaaacagtgcaagttattatggaaatgcgtgacggtgcgattaagaaggtggatcctgtaacctatgcaagattcttactcttcttcccaactatttcatcaggtcctattgatcgatatcgtagatttaagaaagattacgataaagttcctacaagagacgcatatattacagatttacaatatgctgtaagatatttgttccaaggatttttatacaaatttattattggttggttctttggtacttattggcttcctaagattagtgccgctgctttagcggtgggaaatgctaatggtggtttgaagttatcatggtggcttcttgcttacatgtattgctacagtatgtacctgttctttgactttgcaggttactcactatttgctgtatcaatttcatacttcatgggtattcataccccaatgaacttcaacaaaccatttatttctaagaatattaaagacttctggaaccgttggcacattacactttcattctggttccgtgattatatctacatgcgattcactttctttgcaatgaaaaaaaagttgtttaagaatcgtattagattgtcacaggtatcatatttcctattattcttgataatgggattctggcatgggttaacatggtattatattgtttatggtatattccatgccactgctatctgtgtcaacgatatgtggctaagatttaagagaaagcataagaaacaaattccacataacaagtttactgaatggtttgccattttcttaactttcaatatggtatgtttcagtttcttgattttctcaggattccttagtcaattgtggtttggctggaag

SEQ ID NO: 150 - protein, 412 aa, Lactobacillus acidophilus
MNFNFINLQPYSNPQYFVYLMIALIPIIIGLYYGHRLKTYEAIFSIVFLFLIFDGSHWQQGVNLLIWLVYEFALTFAYQYYRHHGKNKTWVFSLAVILAIIPLAAVKYLTAFPLNSINFVIGFLGISYVTFKTVQVIMEMRDGAIKKVDPVTYARFLLFFPTISSGPIDRYRRFKKDYDKVPTRDAYITDLQYAVRYLFQGFLYKFIIGWFFGTYWLPKISAAALAVGNANGGLKLSWWLLAYMYCYSMYLFFDFAGYSLFAVSISYFMGIHTPMNFNKPFISKNIKDFWNRWHITLSFWFRDYIYMRFTFFAMKKKLFKNRIRLSQVSYFLLFLIMGFWHGLTWYYIVYGIFHATAICVNDMWLRFKRKHKKQIPHNKFTEWFAIFLTFNMVCFSFLIFSGFLSQLWFGWK

SEQ ID NO: 151 - DNA, 237 bp, Lactobacillus acidophilus
  misc_feature (0)...(0): ORF 1924 - DltC D-alanyl carrier protein
  CDS (1)...(237)
atggacactaaacaaggcgtattagacattttaaacgatttaactggtgaagatttatcagatcaaatggatgaaaacatctttgataatggtttgatggactcaatggcaagtgtacaaatgcttttgagtttacaagaaaaatttgatattgatgttcctgtatcagaatttaatcgtgaagaatgggacactcctaacaagattgttgcaaaggtggaaagcttagaaaatgag

SEQ ID NO: 152 - protein, 79 aa, Lactobacillus acidophilus
MDTKQGVLDILNDLTGEDLSDQMDENIFDNGLMDSMASVQMLLSLQEKFDIDVPVSEFNREEWDTPNKIVAKVESLENE

SEQ ID NO: 153 - DNA, 1284 bp, Lactobacillus acidophilus
  misc_feature (0)...(0): ORF 1923 - DltD extramembranal transfer protein
  CDS (1)...(1284)
atgagtaataaacgccggctgtggcaaatttttggcccagttctttgcgcttttatccttttattagttgtatttcttattccctgggaaagaactttttctaagcaaactatctatgaagcagctgcctcacaaaatagtactgtatttaagggcagtacaatgaagcaagaagcttataaagatggttatgtaccattctatggttcaagtgaattgtctagatttgatccacttcaccctagtgttattgctgaaaagtatcacagaaattaccgtccatttcttctaggtggaccaggtagtcaatctttggctcaattcttggggatgcagggtacaactaaacagcttaaaaacaaaaaggctgtagtgattatttcaccacaatggtttaccaagaaaggccaagatcctaatgcatttgctttatattattcaccacttcaagcatgtaacttcttgttaagtgctaagaataataagactgatcgttatgctgctaagcgtctgcttgatatgccagatgtaaagggtgaaattagaaacagtcttaagcaaattgctgcaggtaaaaagctaactacttttgaaagattttatttagaaaatcgtcgtagaatgttacgtaacgaagataacttctttagttcattccaattacgcgatcgtgtaaataagattcaaaatagagctaaagtattacctaatacttattctgtagctgctttgaacaaggtggctgaagaacaggctgcagcacatactacttcaaataacttgggaattgacaatactttctatagaactcgtttgcctagaaaggtattaaagagactcaagggtagtcaacgtcactttgattacgttagatctgttgaatatggcgacttccagttaatgctggaacaatttgccaagcaacatactaatgtgttgttcattattccaccaattaatggtaagtggatgaagtatactggtttatcacaaaaaatgtatcaagaatcagttgctaaaattgaacaacaattgactagtcaaggttttgaaaatattgcagatctttctaaacgtggtaatgaaaagtacttcatgcaagatactattcaccttggttggaaaggctgggtagctgttgatcaagctgttagaccatttatgaagttgcctaacgaacgttacaactatgatatgtctaactactacttctcaaagaagtggcagaataaagataacgttaaacgtgtaaatttaaataataaagatcgtttaaaagtgaag

SEQ ID NO: 154 - protein, 428 aa, Lactobacillus acidophilus
MSNKRRLWQIFGPVLCAFILLLVVFLIPWERTFSKQTIYEAAASQNSTVFKGSTMKQEAYKDGYVPFYGSSELSRFDPLHPSVIAEKYHRNYRPFLLGGPGSQSLAQFLGMQGTTKQLKNKKAVVIISPQWFTKKGQDPNAFALYYSPLQACNFLLSAKNNKTDRYAAKRLLDMPDVKGEIRNSLKQIAAGKKLTTFERFYLENRRRMLRNEDNFFSSFQLRDRVNKIQNRAKVLPNTYSVAALNKVAEEQAAAHTTSNNLGIDNTFYRTRLPRKVLKRLKGSQRHFDYVRSVEYGDFQLMLEQFAKQHTNVLFIIPPINGKWMKYTGLSQKMYQESVAKIEQQLTSQGFENIADLSKRGNEKYFMQDTIHLGWKGWVAVDQAVRPFMKLPNERYNYDMSNYYFSKKWQNKDNVKRVNLNNKDRLKVK

SEQ ID NO: 155 - DNA, 1431 bp, Lactobacillus acidophilus
  misc_feature (0)...(0): ORF 1724 - oligosaccharide repeat unit transporter
  CDS (1)...(1431)
atgaaggttgtaagaaattacctttataatgttggatatcaagtactagcaattattgtacctttaattacatcagcttatgttagtcgggtacttagacctgaaggtgttggtgcaaatgcatttactaattcaataattcaatattttatactttttgcaagtatgggcataggctattatggtaatcgtcagattgcttatgtacgtgaagattcacataagatggcgcaaacattttgggaaattcaaatagtaaaaacaatgatgacacttttgtctattattgcatttgaaattttcatgatgttctatacaagacaacctgaatatatgatcgctcaatccattaatttagtggcagttgcatttgatatatcttggttttacgaaggaatagaagactttaaggttacagtcttaaaaaattcttttgttaaattaatatctatggcagcaattttcctattaattaagggaccatatgatgtgactttatatattgttgttttagcggtttcaacattattaggaaatttgactttatggcctaatattaaaaaagatcttcctaaaattaacataaatattttaaatccatggcgacattttttgcctatggcagaattatttattccacaaattgctacacaagtatatgttcaattaaataaaactatgcttggtggtatggtaagtgaaacttccgcgggatactatcaatactctgataatctggttaaactgattttagctctagtaactgcaacaggtactgtcatgcttcctcatgttgctaatgccgtgtcaaaaggaaatatgcgagaagtcaatcaaatgttatataaatcatttgattttgtttcggctgtgtcatatccaatgatgtttggcttagctgcaatttctttaacattagcaccaaaatattatggcccagggtatgatcctgttggcccagctatgatgatagaatctattgttatattgatgattgcctggagcaatgtacttggagttcaatatttgttacctattaatcatcaacgtgattttacagtttcagtaacagtaggtgcggttgttaatgttattttaaatataccgttaattcataattggggtttagatggtgcaatgtggtctactgttatttctgaaatttcagttactttgtatcaactatgggctgttaaaggattactaaattatagacaactttttttaaattcttggaaatatttattgtcagggataattatgtttgttcttgtattttggatgaatcagcatttccaagatagttggctaatgatgggattagaaattattattggtgtaataatatatggtgtaatgattatattttttaaggcacctattattgatcaggcaaagaaaatagttaatgataaattgaaaaatgtaaaa

SEQ ID NO: 156 - protein, 477 aa, Lactobacillus acidophilus
MKVVRNYLYNVGYQVLAIIVPLITSAYVSRVLRPEGVGANAFTNSIIQYFILFASMGIGYYGNRQIAYVREDSHKMAQTFWEIQIVKTMMTLLSIIAFEIFMMFYTRQPEYMIAQSINLVAVAFDISWFYEGIEDFKVTVLKNSFVKLISMAAIFLLIKGPYDVTLYIVVLAVSTLLGNLTLWPNIKKDLPKININILNPWRHFLPMAELFIPQIATQVYVQLNKTMLGGMVSETSAGYYQYSDNLVKLILALVTATGTVMLPHVANAVSKGNMREVNQMLYKSFDFVSAVSYPMMFGLAAISLTLAPKYYGPGYDPVGPAMMIESIVILMIAWSNVLGVQYLLPINHQRDFTVSVTVGAVVNVILNIPLIHNWGLDGAMWSTVISEISVTLYQLWAVKGLLNYRQLFLNSWKYLLSGIIMFVLVFWMNQHFQDSWLMMGLEIIIGVIIYGVMIIFFKAPIIDQAKKIVNDKLKNVK

SEQ ID NO: 157 - DNA, 522 bp, Lactobacillus acidophilus
  misc_feature (0)...(0): ORF 1725 - UDP-galactopyranose mutase
  CDS (1)...(522)
atggttgaaaatatgttgggtgatcctgatatcacagttaaattaaatactgatttttttgataataaagatgattacttaaagaactttgacaagattatttatactggtatgattgataaattctttgattataaattaggtgaactagaataccgttcacttcgttttgaaactgaagaaaaagatgtaaataattaccaaggaaatgcagtgatcaattatactgaagcagaaattccatatactcgtgtaattgaacacaagcattttgaatttggaaaaggtgacaatgataaaacaatcatcactcgagaatacccagctgattggaaacgtggtgatgaaccttattatccaataaataataagcgtaataatgacttatatgctaagtatgcagaattagctaaaaagcaggataaagttatttttggtggacgtcttggtcaatataagtattacaatatggatcaagttattgcagcagcgcttgataccgttaatagtgaatttggtgat

SEQ ID NO: 158 - protein, 174 aa, Lactobacillus acidophilus
MVENMLGDPDITVKLNTDFFDNKDDYLKNFDKIIYTGMIDKFFDYKLGELEYRSLRFETEEKDVNNYQGNAVINYTEAEIPYTRVIEHKHFEFGKGDNDKTIITREYPADWKRGDEPYYPINNKRNNDLYAKYAELAKKQDKVIFGGRLGQYKYYNMDQVIAAALDTVNSEFGD

SEQ ID NO: 159 - DNA, 399 bp, Lactobacillus acidophilus
  misc_feature (0)...(0): ORF 1726 - UDP-galactopyranose mutase
  CDS (1)...(399)
gtgaagacatatttagttgtaggttctggtctttttgcagctgtgtttgctcacgaggctgcaaaacgtggaaataaagttaaggtaattgaaaaaagagaccatattgcaggcaacatctatactaaagaaatagatggcattcaagttcataaatatggtgctcatattttccatacttctaataagaaggtttgggattatgttcatcaatttgcggattttaatcgctatactaatagtcctgttgccaattataagggacatatgtataacttacctttcaatatgaatacctttagtgaaatgtggggtgttagaacaccacaagaagctatggctaagatcaatgagcaacgtcaagaaatggctggaaaagaaccgcaaaatttagaagag

SEQ ID NO: 160 - protein, 133 aa, Lactobacillus acidophilus
MKTYLVVGSGLFAAVFAHEAAKRGNKVKVIEKRDHIAGNIYTKEIDGIQVHKYGAHIFHTSNKKVWDYVHQFADFNRYTNSPVANYKGHMYNLPFNMNTFSEMWGVRTPQEAMAKINEQRQEMAGKEPQNLEE

SEQ ID NO: 161 - DNA, 1293 bp, Lactobacillus acidophilus
  misc_feature (0)...(0): ORF 1727 - polysaccharide polymerase
  CDS (1)...(1293)
atgattttattagtcattactctcttagggttatctataacatcttattatttaaataatagaaatttagtttctccagcatttcttttaagcacaactttttttatttgttctttggttgctttaattaatcaaaataaatggcaacttattttaaatagaaaaacatacttagttatttgtggtgccatattagaatttattatagtgacatatttagttaataaactgttgtctgtagttaaatttcaatataaaaatagtaaaaaatcaaaattaaatgcgccttatattagcacgagaaaatcatacatattgtttgctatacagttattattaattatttatgtaattaggaatctaaaagaagttactaaaataaataatatttttcaagctgcttcggcattaaaccaatctagtttgcccaattatatagggcagcctattgcattatcgaaaattgctaatattttcttggcattcatattagcaagtggtttatatacaggttatgttttttttctatatattattgtaaagaaaaactttagatttgacttatttattaatatgtttattagtatattagctccatttgttactggatcgcgtggcaattctatttatatgatcatttcttgggttatatattgttacttgatattgtggaaaaacaataaattgaattttaaaatgcagtttaaatttgttatgagaataaccctagttttgattatattacttttgttattgcccctaacagccgttttatttggtagaagaatggataattgggatgaatatcttagtatttatataggtgcacaaataaagaatttaaatgaattcatcttaaataataattttccattgcaaacaagtatatttggacagcaaacattttttacaataattcctttggtttcaaaattaattggactaaatattcctagttataagttggatttaccatatcaagcaatcggaagtttatctttaggaaatgtgtatacgacattttacccttggttatatgattttggttataaaggtgtttttcttttaacattaatcatggcaatagtcgtagaatttatatatcatttagcattacatagtaaattgcaattcggattaagtatactgttatatggatatttaggaagctttgtagcattattgtttttctctaataagttttatgaaggactaaattctactttgattttaataataatgtcatggatactactaatttacatttttaagcaaaagaaagggaaaataaag

SEQ ID NO: 162 - protein, 431 aa, Lactobacillus acidophilus
MILLVITLLGLSITSYYLNNRNLVSPAFLLSTTFFICSLVALINQNKWQLILNRKTYLVICGAILEFIIVTYLVNKLLSVVKFQYKNSKKSKLNAPYISTRKSYILFAIQLLLIIYVIRNLKEVTKINNIFQAASALNQSSLPNYIGQPIALSKIANIFLAFILASGLYTGYVFFLYIIVKKNFRFDLFINMFISILAPFVTGSRGNSIYMIISWVIYCYLILWKNNKLNFKMQFKFVMRITLVLIILLLLLPLTAVLFGRRMDNWDEYLSIYIGAQIKNLNEFILNNNFPLQTSIFGQQTFFTIIPLVSKLIGLNIPSYKLDLPYQAIGSLSLGNVYTTFYPWLYDFGYKGVFLLTLIMAIVVEFIYHLALHSKLQFGLSILLYGYLGSFVALLFFSNKFYEGLNSTLILIIMSWILLIYIFKQKKGKIK

SEQ ID NO: 163 - DNA, 1038 bp, Lactobacillus acidophilus
  misc_feature (0)...(0): ORF 1728 - glycosyl transferase
  CDS (1)...(1038)
ttgaagaaaaaaacattaactatcggggtagctgcatataatgcggcaaaaattatttctaattgtttagatagtttactcattgatgaagtaaaaaatgatatagaagttttagttattaatgatggctccacagataacatacaaagtgttgtagctacgtatgaaaatagatatcctaatagtatacggttaattaataaaaaaaatggaggacatggttctacaattaataagacaatagaagaagctaagggcgagtatttaaaaatggtggatgctgatgatagtgttgaaaaacaaggtttcatagcattagtacgtcatctgaagaaaaccaatgctgatgttgttatgtcaccgtattatagagtaaatattgttaataatcataaaaaattaataggttatttaaagtcttcgaataaggagagtattgttgataataaactcgtaaatctgcaggatatttatcaagacttattggtagcaatgcatagtttgacttacaggactactttgttaaaggaaaataattataaaatagatgaacattgtttttatgtggatgttgaatattctatttactatttcttaaaagctaagaatgtattattacttaatgaacctgtatataactataatataggttcctctgatcaaagtgttaatatagataatatgagagctagaagggcgcaacacttaagggtagcaaaaagtatggtgaacttttataaaaaagaaagaaataaaattccttcatatatgaaaagcttttttaaaaataatatagttaatatgatcttagttaatgaatataagttattaatgtcactaaaatcaagtaaaaactcaaaaatagaattgataaaattcgataaatatttaaaaaagaattctattgagttatatgagggtgtcacaacctttaataatagtaaaaaaataaaactacttaaaatattgagaaaaataaattttaatggatataccatagttcataatttatgtaaaaagtcgttgactactcatata

SEQ ID NO: 164 - protein, 346 aa, Lactobacillus acidophilus
MKKKTLTIGVAAYNAAKIISNCLDSLLIDEVKNDIEVLVINDGSTDNIQSVVATYENRYPNSIRLINKKNGGHGSTINKTIEEAKGEYLKMVDADDSVEKQGFIALVRHLKKTNADVVMSPYYRVNIVNNHKKLIGYLKSSNKESIVDNKLVNLQDIYQDLLVAMHSLTYRTTLLKENNYKIDEHCFYVDVEYSIYYFLKAKNVLLLNEPVYNYNIGSSDQSVNIDNMRARRAQHLRVAKSMVNFYKKERNKIPSYMKSFFKNNIVNMILVNEYKLLMSLKSSKNSKIELIKFDKYLKKNSIELYEGVTTFNNSKKIKLLKILRKINFNGYTIVHNLCKKSLTTHI

SEQ ID NO: 165 - DNA, 654 bp, Lactobacillus acidophilus
  misc_feature (0)...(0): ORF 1729
  CDS (1)...(654)
ttgaaaaaactcctaaaattttacccaaataaaccatataaaattaactttgaaaataaagatgatgatacttcaagaatatcagatattatagagacaatgcgaagtgatcaacgattaaaaatattatatcaaggtgtatttgataaagatagaaaattagatgaatttgcaaagacaattgaaaatgaaagtgataaattttgtctttatataatgggaaaacaaaataaatatagtaaagaactttgtaaaaaatatccccatattcgatatataccatatataacatcaccgaatcatttgaaaataacaagagaagcagatattggattactaccatattttccagtaagagttggtaataattcaatattaaatgcgttatattgtgcaccgaataaaatttatgaatactctgcatttggtaagccaatgctaggaactgatgtcttagggttaaaatatccttttgaaaagtataaaatggggtatacggtttcaaaattagaagaaaaagaaattttagaaaaattaaataaaatacttgtcaattatcagaagatgagtgaaaattccagacgtttctttcaatctgttaattgggataagaaaattgatgaaattttggagattaaagaagaggaaaaagat

SEQ ID NO: 166 - protein, 218 aa, Lactobacillus acidophilus
MKKLLKFYPNKPYKINFENKDDDTSRISDIIETMRSDQRLKILYQGVFDKDRKLDEFAKTIENESDKFCLYIMGKQNKYSKELCKKYPHIRYIPYITSPNHLKITREADIGLLPYFPVRVGNNSILNALYCAPNKIYEYSAFGKPMLGTDVLGLKYPFEKYKMGYTVSKLEEKEILEKLNKILVNYQKMSENSRRFFQSVNWDKKIDEILEIKEEEKD

SEQ ID NO: 167 - DNA, 519 bp, Lactobacillus acidophilus
  misc_feature (0)...(0): ORF 1730
  CDS (1)...(519)
atgagagttttaattgtacataatagagaaattagcgattttccgcctgttagaagtctggttgatgctttaatagctaataaagttaaaaccactataattactcgagatgaaaataatgtattagatagttatggtgataaattaaaagttttggaattattgccatatgcttcaaatggtaattttaaaaatacttataaattttttgaaaatagaaagctaattagaaaatgggtaaagaaggagatgaaaaataatgatattatttggacaactacggatgcaactgttcgagaaattggacctgatttgcttaattacaaacatgttatgcaattaatggaattagttgaatacgtgccaaaattccctttaattcctaaaaaaaatttatttaaattcaatataactaaatatgcccatcatgcttggaagatagtggtacctgaaataaatagagcttatattcaaaaggtatggtgggatcttgaaaaaactcctaaaattttacccaaa

SEQ ID NO: 168 - protein, 173 aa, Lactobacillus acidophilus
MRVLIVHNREISDFPPVRSLVDALIANKVKTTIITRDENNVLDSYGDKLKVLELLPYASNGNFKNTYKFFENRKLIRKWVKKEMKNNDIIWTTTDATVREIGPDLLNYKHVMQLMELVEYVPKFPLIPKKNLFKFNITKYAHHAWKIVVPEINRAYIQKVWWDLEKTPKILPK

SEQ ID NO: 169 - DNA, 879 bp, Lactobacillus acidophilus
  misc_feature (0)...(0): ORF 1731 - glycosyl transferase
  CDS (1)...(879)
atgaataatatagcagcgatagtagttacatataatagaaaaaaattattaaaaaaatgtattaaaggactaaaagagcaaacagaaaaagctgatatcattattattgataatatgagtactgatggtactttagaaatgttacagcctttaattaattcaaacgaaataatttatcactcgactggaaaaaatattggtggtgctggtggcttttatgagggaataaaactagcttatgaaatgggatataaatatttttggttaatggatgatgattgtattccaacttcttccgctttagaaaaattaatgaatgtagtaaatgagaaaaaaaattttggttttttggtaagtaaagccctatggaaagatggagaagtatgtaaaatgaatatacctaagataaaacttaccaagcaagtaaatgatttctcaaaaaaggttattcaaattaaaatgggaacattcgtttcgtttctaacctcaagagaagtagtagaaaaagtaggattacctataaaagaattctttatttggggggatgatttggaatatagccaaagaatttcccaaaaatttccatcttatttggttacaaatagtcttgtgtatcatgaaactaaattgaatgaagggtctaatattgcattagatagcgttgatcgtttaaaacgatataaacttgcatatagaaatgaagttgttttgtttaaagaaatgggattgcaagggcaaatgtatcaatattttcgtttagttctgcattgtggacggattctgtttaagagcaaagatcataaaaaagaacgattgaatattatttttcaaggcacacgagctggatataatttccatcccgtaataaaaaatatcaaa

SEQ ID NO: 170 - protein, 293 aa, Lactobacillus acidophilus
MNNIAAIVVTYNRKKLLKKCIKGLKEQTEKADIIIIDNMSTDGTLEMLQPLINSNEIIYHSTGKNIGGAGGFYEGIKLAYEMGYKYFWLMDDDCIPTSSALEKLMNVVNEKKNFGFLVSKALWKDGEVCKMNIPKIKLTKQVNDFSKKVIQIKMGTFVSFLTSREVVEKVGLPIKEFFIWGDDLEYSQRISQKFPSYLVTNSLVYHETKLNEGSNIALDSVDRLKRYKLAYRNEVVLFKEMGLQGQMYQYFRLVLHCGRILFKSKDHKKERLNIIFQGTRAGYNFHPVIKNIK

SEQ ID NO: 171 - DNA, 771 bp, Lactobacillus acidophilus
  misc_feature (0)...(0): ORF 1732 - galactosyl transferase
  CDS (1)...(771)
atgaaaataaaaattttagttgctgcacataagaaatttccaatgccaaatactgatggatatatgcctgtgttagtaggtgcagctaaaaattataaaccagacattaaatatcaaagagacgacgagggtgataatatatcttttaagaatccaaattataatgaactgaccgctgtttattgggcttggaagaatttggaaaatgtagatgcagtaggtcttgtccactatcgtcgtctcttttttgatacgaaaccgtatacgttaagtaatgttattagtatcaaaaaaatagaagaattactaactcaatatgatgtaatccttcctaaaaaaagaaactattatattgagacaaattattctcattatatacatgctcatcatcgggaacctttagatagaacgagagatgtagttgcccaaaattatccacaatatttatcaaattttgataaagcaatgcatagaagaaaagcgcatatgtttaatatgttcataatgcgtaaaaaggtttttgaatcatattgtaattttgtttttggtgtattgagtaaattagaaaatataatagatatttcaaattattctgtacaagaagcaagagtatatggatatatttcagaattgttaatggatgtttggcttgaaactaatggaatcaaatatgttgaaatgccatggggacagattggcggtaagaataatgtgaaaaaggctatttttcttataaaaagaaagatgggaataaagactaaaacacacttt

SEQ ID NO: 172 - protein, 257 aa, Lactobacillus acidophilus
MKIKILVAAHKKFPMPNTDGYMPVLVGAAKNYKPDIKYQRDDEGDNISFKNPNYNELTAVYWAWKNLENVDAVGLVHYRRLFFDTKPYTLSNVISIKKIEELLTQYDVILPKKRNYYIETNYSHYIHAHHREPLDRTRDVVAQNYPQYLSNFDKAMHRRKAHMFNMFIMRKKVFESYCNFVFGVLSKLENIIDISNYSVQEARVYGYISELLMDVWLETNGIKYVEMPWGQIGGKNNVKKAIFLIKRKMGIKTKTHF

SEQ ID NO: 173 - DNA, 651 bp, Lactobacillus acidophilus
  misc_feature (0)...(0): ORF 1733 - phospho-glucosyltransferase epse
  CDS (1)...(651)
atgatggcgatggaaagactgaaagttaatcctaagaaggtatataatcgacctttttatcacacagttaagcggttatttgatatcgtagccagtgcgattggattagttcttctatcaccattatttttgtatctaattattagaattagacacgaagatggtggcccagcattttattcgcaagagcgaattggtaagaatgaaaagccatttagaatgtggaagtttcgttccatggttgttaatgcagataagatgctggataaattagaagatcaaaatgaagtcaatggagctatgtttaagattaaagatgatccaagaattaccaaaattgggcatatgattcgtaaatatagtcttgatgaattaccacaattatacaatgttctgatcggagacatgtcgttagtaggaccacgtccacctcttccttctgaagttgaagagtatacggattatgataaacaacgtctattagttatgcctgggtgtactggactttggcaagtaacgcgtagaaatgaagcagactttgatgaaatggtatggcttgatattgtttatatcaatcattctggattgtgggaagactttaaattgattattaagaccgtattagttatgattcatccgaatggggcttat

SEQ ID NO: 174 - protein, 217 aa, Lactobacillus acidophilus
MMAMERLKVNPKKVYNRPFYHTVKRLFDIVASAIGLVLLSPLFLYLIIRIRHEDGGPAFYSQERIGKNEKPFRMWKFRSMVVNADKMLDKLEDQNEVNGAMFKIKDDPRITKIGHMIRKYSLDELPQLYNVLIGDMSLVGPRPPLPSEVEEYTDYDKQRLLVMPGCTGLWQVTRRNEADFDEMVWLDIVYINHSGLWEDFKLIIKTVLVMIHPNGAY

SEQ ID NO: 175 - DNA, 768 bp, Lactobacillus acidophilus
  misc_feature (0)...(0): ORF 1734 - epsD
  CDS (1)...(768)
atgactttagttgatattcactgtcacattttgccaggaattgatgatggatcaaaagattgggaaacatcaattaagttggcaagggatgctgtaaaagatggtataacacatgcagtatgtacaccacatacgttaaatggaaaatatcttaatcacaaagatgatgtgattcgattaactgagaactttcaagatatgcttgatgaagcaaagattccattaacagtatttcctgggcaagaagtgcgtatttcaggcgatttgcctgatgcattagataatgatgacattctcttcttagatgaagagggacaatacatgttattggaatttccaagtgatgatgtaccaacttatgctaaagatatgatctttagcattcaacaacgtggtattacaccaattgttgtgcatccggaacgtaacagtagaatcttaaaagagccacatatcttgcaagaattaattgagcaaggttgtctagttcaaattactgctagttcatatgttggaacatttggccagaaaatagaagaaatgagtagacgcttcattgaagctggacaatgtgcttgctttgcatccgatgctcatgatctgcctaagagacaatatgaatatagtgcagcattaaagaagttgagcaatgaatttggaagtggacgtgctcaagaattcgaagataatgctcgcgcaattgtgaacggcgataatgttcaattgaattggcgaccacttaagaaaaagaagaagttttggttattt

SEQ ID NO: 176 - protein, 256 aa, Lactobacillus acidophilus
MTLVDIHCHILPGIDDGSKDWETSIKLARDAVKDGITHAVCTPHTLNGKYLNHKDDVIRLTENFQDMLDEAKIPLTVFPGQEVRISGDLPDALDNDDILFLDEEGQYMLLEFPSDDVPTYAKDMIFSIQQRGITPIVVHPERNSRILKEPHILQELIEQGCLVQITASSYVGTFGQKIEEMSRRFIEAGQCACFASDAHDLPKRQYEYSAALKKLSNEFGSGRAQEFEDNARAIVNGDNVQLNWRPLKKKKKFWLF

SEQ ID NO: 177 - DNA, 780 bp, Lactobacillus acidophilus
  misc_feature (0)...(0): ORF 1735 - epsC
  CDS (1)...(780)
atgccattatttaagaaaaagcgtggtacagatgaaactattaaacatggtgctaagttaatcactgtagctaagccaaagagtccaatagctgaacaattccgtactgttcgtactaatattaactttatggcagtggatcatgacattaagtctttagcatttacttctgctaatattagtgaaggtaaatctactgtggctgctaacgttgctgttacttatgctcaagcaggtcgtaaagtcttattggtcgatgccgacttacgtagacctacagtgcactcaacctttaacttaagtaatcatgttggtcttagtacggttatctcttcaactgctaaggaagttgatcttgatagcgtagtacaagagagcggcgtagataatctttacgtgttaacggctggtccgatgccacctaacccggcagaactgataggttctaagcgtatgcgtgactttgttaaacttactgaagaacactacgatttagttattatcgacttagctcctgttcttgaagtatctgatacacaagaacttgctagtcacttagatggggttgtcttagtagttcgccaagggaagacgcaaaagatggccattaagcgtgctgttgaaatgcttgaatttgcaaaggcacgtatcttgggttacatcatgaatgatgtaagttctgataatgcgggttatggctatggttacggctacggctatggttatggctacggagaagaagatacaaagaaaaaaggattgttctctaaatttaggaag

SEQ ID NO: 178 - protein, 260 aa, Lactobacillus acidophilus
MPLFKKKRGTDETIKHGAKLITVAKPKSPIAEQFRTVRTNINFMAVDHDIKSLAFTSANISEGKSTVAANVAVTYAQAGRKVLLVDADLRRPTVHSTFNLSNHVGLSTVISSTAKEVDLDSVVQESGVDNLYVLTAGPMPPNPAELIGSKRMRDFVKLTEEHYDLVIIDLAPVLEVSDTQELASHLDGVVLVVRQGKTQKMAIKRAVEMLEFAKARILGYIMNDVSSDNAGYGYGYGYGYGYGYGEEDTKKKGLFSKFRK

SEQ ID NO: 179 - DNA, 873 bp, Lactobacillus acidophilus
  misc_feature (0)...(0): ORF 1736 - epsB
  CDS (1)...(873)
atggaacaaaaacaagaacaagaaaatacaatcgatcttacccaattattacgcatttgccgtaagcatatctgggcattgattctttggagtgtaggtcttgccttagtgggctggggagtttcagaatttgtaatttctcctaaatatacttcaactgctcaattattagttaaccaaaagagtcgtaacaatgatccaaacgcagcttatgcgactcaacaagctaacatgcagatggttactacttataaagacattgtaacaagtaacaagatcttaacagaagcttctaatcgtttggccaatccaactgttgttgtgaaaaaagcacaaaaagcagtgtacagaactgatgaaaatggtagaagaagattagtaagaaaagctcaaccagctgtaattgaacgaagcggtaagagttattcagtttctgcaagtgaacttgctaagagtatctcagtaggtacccaacaacaatcacaagtcttctcaatttcagcggaagccgatacaccagctaaggcgaaggcagaagtaaatgcagtagctgaaacgttccgtaaagaaattcctactattatgagcgttaataacgtaacgattgtggcaaatggtactaatggtgttcaatcctcacctaacgttaagttgttcactctagctggatttgtagttgggttagtattgagctttgctgtagttattattcgtgaaatgagtaatactactgttcgtgacgatgaattcttaactcgtgaattaggcttaactaacttaggtcaaattgctcacttccacttgtcatcttcatttactattaaaaagagtgcaaatatgactaatcgtggacaagctaagagacgtagagta

SEQ ID NO: 180 - protein, 291 aa, Lactobacillus acidophilus
MEQKQEQENTIDLTQLLRICRKHIWALILWSVGLALVGWGVSEFVISPKYTSTAQLLVNQKSRNNDPNAAYATQQANMQMVTTYKDIVTSNKILTEASNRLANPTVVVKKAQKAVYRTDENGRRRLVRKAQPAVIERSGKSYSVSASELAKSISVGTQQQSQVFSISAEADTPAKAKAEVNAVAETFRKEIPTIMSVNNVTIVANGTNGVQSSPNVKLFTLAGFVVGLVLSFAVVIIREMSNTTVRDDEFLTRELGLTNLGQIAHFHLSSSFTIKKSANMTNRGQAKRRRV

SEQ ID NO: 181 - DNA, 1053 bp, Lactobacillus acidophilus
  misc_feature (0)...(0): ORF 1737 - epsA
  CDS (1)...(1053)
atggcagaaaataatcaaccaaataatgatgtacgtcgccatcaccaccatagacatcaccgtcatcaccatcgtaagttttggcattggttctggattgtgatcggcgttattgtagtcattgtactttttgtttgtggtatggtttataagaatttacgcgataccacgcaaaatatgtatactcccgttgctaagacaactaagagcaacaagggacgtaatcttgataatttgctagcgcagaaaaaaccaatcaatattcttttgctcggtactgatactggagcaatgggacgtagctggaaaggacgtactgataccatcatgatgatggcaattaatcctaagactaatagtacgtcaattgtatctattccacgtgattcaaatgcaatcttcccagatttcccacaatatggagtaacgaagattaactctgcttatacactaggcggagttggtgaaacagttaagacattggataaatactatagtgtgccaattgacggttacattatgatcaacatgggtggtcttaagaaggctattgatcaagttggtggtattgatgtaacttcaccattgactttcgacaatatgggataccacttccaagaaggtaagacctaccatatggatggtaagaaggcattagcctttgctcaacttagacatggggatccacgtcaagattatggtcgtcaagaccgtgatcgccgtgttgtcatggcacttcttaagaagtctatctcacctactacattacttaatactaaattcttgaattcaatctcaagtgaaatgcaaactgacttgactatgaatcaaatgtacaagatcgggatggattatagacatgcaacagataacttgtcacaagatcatgctcaaggtgtaagtaagcaaactcagaatcctaagtttggtactatggaaatcgaagtagtaagtagacaagaaaggcaaagagtgtctgataaattaagagcagcattaggtcttcctaaggtacgagttgctgctaatagtgccagctatgtcatgaatcaa

SEQ ID NO: 182 - protein, 351 aa, Lactobacillus acidophilus
MAENNQPNNDVRRHHHHRHHRHHHRKFWHWFWIVIGVIVVIVLFVCGMVYKNLRDTTQNMYTPVAKTTKSNKGRNLDNLLAQKKPINILLLGTDTGAMGRSWKGRTDTIMMMAINPKTNSTSIVSIPRDSNAIFPDFPQYGVTKINSAYTLGGVGETVKTLDKYYSVPIDGYIMINMGGLKKAIDQVGGIDVTSPLTFDNMGYHFQEGKTYHMDGKKALAFAQLRHGDPRQDYGRQDRDRRVVMALLKKSISPTTLLNTKFLNSISSEMQTDLTMNQMYKIGMDYRHATDNLSQDHAQGVSKQTQNPKFGTMEIEVVSRQERQRVSDKLRAALGLPKVRVAANSASYVMNQ

SEQ ID NO: 183 - DNA, 1263 bp, Lactobacillus acidophilus
  misc_feature (0)...(0): ORF 1738 - GTP-binding protein (HflX)
  CDS (1)...(1263)
atgatagataatcaacctaaaaaaactaaggcctatatcgcaggcgttaacttgaaggatcctaacttcgactactacatgactgaacttgctaacttaactgaagcaaataatatggaagtagttggtcaaagctcacaaaacgcggaatcaatcgttgccggaacttacttcggtgtcggcaagattaacgagattaagtcgatggcccaaggcttgaaagctaaagtcttggtcttaaatgatgaattaactccagtacagatccgtaatcttgagaagttaaccaagatgcgcgtgattgatcgaactgaattaatcttagaaatcttcgccagtcgtgcaagaactaagcaagctaagctacaagttcaactcgccagattgcagtacgaattgccacgtcttcacccttccgagaacaacctggaccagcaacgtggtggtggcttctccaaccgtggtgccggtgaaagtaaacttgaattaaatcgtcggacaatcggtaagcaaatctctgctattaagaaagaactcaaggctgttgccagccaagaagagattaaatcagctcgccgtaatcaaagtcgcatccctaaagttgctcttgtcggctacaccaacgccggcaagtccacaacaatgaacggcctactccgcgaattctctaaagaaggcagcgacaaggaagttttcgttaagaacatgctctttgccactctggacaccagcgtgcgtcgtattgatttaaaagataatttcagttttatcttgtctgacaccgttggttttatttctaagttaccacacaacttagttgaatcattcaaggcaaccttgcaagaaacacgcgacgctgatcttttgattaacgtggttgatgcatccgaccctaacatggtccagatgatccgcactacacagaacgtgctagacgagatcggcgttaaaggcattccaatgatcaccgcctacaacaaggccgacaagaccgaccgcaattatccacagatcgaaggtagcgacattctttattcagcaactgatcccaagtcaattaagctcttggctgatctcatcactaagcgtgtcttctctgattatggcaagttcaacctcacacttcctttgagtgcaggtaaggaactggcctacttacacgagaatgctcagatcttgagtgaaaactatgaagacgacggcgtccacatcgaagccaacattgcaccggatgatcaaggtcgttttaaagaatatctagtc

SEQ ID NO: 184 - protein, 421 aa, Lactobacillus acidophilus
MIDNQPKKTKAYIAGVNLKDPNFDYYMTELANLTEANNMEVVGQSSQNAESIVAGTYFGVGKINEIKSMAQGLKAKVLVLNDELTPVQIRNLEKLTKMRVIDRTELILEIFASRARTKQAKLQVQLARLQYELPRLHPSENNLDQQRGGGFSNRGAGESKLELNRRTIGKQISAIKKELKAVASQEEIKSARRNQSRIPKVALVGYTNAGKSTTMNGLLREFSKEGSDKEVFVKNMLFATLDTSVRRIDLKDNFSFILSDTVGFISKLPHNLVESFKATLQETRDADLLINVVDASDPNMVQMIRTTQNVLDEIGVKGIPMITAYNKADKTDRNYPQIEGSDILYSATDPKSIKLLADLITKRVFSDYGKFNLTLPLSAGKELAYLHENAQILSENYEDDGVHIEANIAPDDQGRFKEYLV

SEQ ID NO: 185 - DNA, 1008 bp, Lactobacillus acidophilus
  misc_feature (0)...(0): ORF 1739
  CDS (1)...(1008)
atgaaaaaacataatttgctggtaatcgctgttgcgttattcgggtgtgttgcacttagcagtgaacctgttcaagcagccaaatattctaaatcagaagctaagaaagttaagtatttccagcgcgaatatcgcggcttgagtaagaccaaatacaaccgcaataccatttaccagcaagcacccaactttgccgatcctttttcaccagggacgttaactcctacatatattcctgatacgatgggctacattaattactatcgtgaattagcaggactgccggctgaagctaatcataacgaagacaatcaaagcgcccaaatcggggcagtagcgttagcttccgttaacgcggccgccaacttgaaggcccatggcctacttgactatcttcgccctagttatattagtgaatctgattgggatatcgctgaaagttctactttaggtaatatcaacttcttggataacgccggtagtacctcagctggtgagatagtaacggatctgattcgcgaggataataatatcgcaggtactgggaacatcggccaccgggccatgatcttatctactcgcgcaacgcggatgggaatcggtgcggcatacggcttaagcaacgatatgctctattctgtggaatacggactatttgccgatgacatcttgcgtacgcccgtgaagaagcaagttgtttatcccgctaccacggtctttccctatgaattaattggcaggaatactccatggtcgtatgcaacaacgaagaagatctctggtacaccgaagatttatattactgatttatccaccaaaaagaagaaacgttatcgcgcaacacaagtacgcaattttaacacgatgttttacggtgaaggttataccacaacgatcacgtatcgcccaggtaagattaagttagttaatacacataagtacaaggtacagattggcaagcattatacatactcatttagattttttagacagaacggaaaattaaag

SEQ ID NO: 186 - protein, 336 aa, Lactobacillus acidophilus
MKKHNLLVIAVALFGCVALSSEPVQAAKYSKSEAKKVKYFQREYRGLSKTKYNRNTIYQQAPNFADPFSPGTLTPTYIPDTMGYINYYRELAGLPAEANHNEDNQSAQIGAVALASVNAAANLKAHGLLDYLRPSYISESDWDIAESSTLGNINFLDNAGSTSAGEIVTDLIREDNNIAGTGNIGHRAMILSTRATRMGIGAAYGLSNDMLYSVEYGLFADDILRTPVKKQVVYPATTVFPYELIGRNTPWSYATTKKISGTPKIYITDLSTKKKKRYRATQVRNFNTMFYGEGYTTTITYRPGKIKLVNTHKYKVQIGKHYTYSFRFFRQNGKLK

SEQ ID NO: 187 - DNA, 4146 bp, Lactobacillus acidophilus
  misc_feature (0)...(0): ORF 1740
  CDS (1)...(4146)
atgaggagacgatgcgaaatgttatctaaaaacaactttaatgagaaacttatgcaaatgaacaatcaaaaagctcatttttcaattcgtaaattaactattggtgctgcttcagtattaatagggatcacttttatgggaattaacggtcaaacagtaaacgctgatgaaatgactggtaatactcaacctgaagcaatgcaagtttcaacggataaatctactgatgccactaccactcaacagaatgattcagatagtagtgctcaaaagaatgctgctcaaacagtagaagttcctcaaaatagtaaacaagataatacaggagaaacttctcaatcaactacagataaaaaagatacacaagttcaaaaaacagaatctagtgaaacaaaggctgatactgctcaaagtcaagtacccccagctgccaaccaaactcaaaaatcagctgaccaaaatgtagaaaatacacaatcaccagttgctagcaatactactcaacctaaaacacaaaatgacagcaaatataacgttgctgactggggtggtagtctcaatgatgaaactcacgagtacaccttaaataaatacaatggtagtgataaagaaaatatctacattccaaatacagaagattttatcaaggctggaaagattacagatatcgacaaagttttcattactaaggatttaattcaaaacattactaaaaatggcgcaaccagtattgtgattgatgatcaaggcagtgaagataaaaataaagtctatgctaaaggagactggagcaatgcttttgctggctctaccaaattaaagagtgtcgatttaagtcatttagatacaagccaagttactagtatggctggtgcatttaatggtgatactggcttaaatgatgctaacttaagtggttggaatattcaaaatatgactaacttgtcctcattattttatggtgcaaataatttgtacaatgtggacatgagtggttggaattttattaacaaccctaatacaaatagcatgttttcatatgcagactacaatttaaagagcgtaaatcttaaaaatgctaaaaatgttactgatgatatattaagaatttacgctagagcaattaagaactctaacgcaaccactgctgacctaagtgatatcaatttatcaccaaatgttactagtttacatggcttgttttctaacatgcctgaccttaagaacgttaacttaagcggtcttgatattagtcatattacagatatgggtggcatgttttctggagatagtaatctagaaagtttagatttaagcggcttggatttaagtaaagtaaccaacaccaataatatgtttgactgggttggtggaaagataaagagtgtaaacattactaacactaagagtattccacgtagcatcttagatatatatctaaaggcactcagcaatacaggtacaacgactgttgatctgagcggtattaatctttcaccaaatgttactagcttacatggtttatttgctaacatgcctaaccttgggagcgctaacttaagcggtcttgatattagccatattacagatatgggcggtatgttctttaatgatacttcattgaagagtgttaacttatctggtcttaacttagaaaaagtaaaagatcttagcacaatgttttacggtgcaaataacttggaaaatgttgattttagtaataccaagtttgcaccagatgctaatacaaacgtaatgtttgcttttgcagatactaaattacaaagcgtaaatattaatggtactaaaaatattacccgtgaagttttagatgccgttattagagcagctaagaattccaacgcaactactcttgatttaagcggtgttagcttttcaccaagtatcaccagttttaataatctattctctaatatgccgaatattgaaagtatagacctaactggctgggacactagtcatattaccgatatgagttacatgttctttaatgatccaaagcttaaaattattaaaggacttgaagatttcaatacctcaaatgtaactaatatggcatacatgtttgctgcttttaacaatccaacaacagataattatgatccaaaaggtcttgagagtttaggacatttgactaaacttgatttaagcaattgggatacttccaatgtaactaatatgctatatatgtttgccggacagactaatttaactagtttgggtgacctttctaagtggaatactagcaaggtaactaatatggcctacatgttctatgatttaaaaaatatagatgacggtaaattagatctaaccggttgggatacttccaatgtaactgacatgagctacatgttctttaacatgttcttacaaaaagatttaagcttcgttaatgattggaacactggtaaagtaactgatatgagttacatgtttgccaatgacaagaaccttgaaaaattagatctttctaaatgggatgtaagtagtgttgggttaaagcatactgaacaaaactacagtctggcaatgatgtttgcgggtgatacttcattaactactgttggtgatatttctcattggaataccaagaatgttcatgatactcgtcaaatgttctataatactcctaagttaactaacattgacttgagtggctggaatacaggtaaattacaaattgctgaagggatgttcaactcctctggcgctaagcaaattaacttagataattgggatttaagtaatattaaacgaattactcctgctggttatgttgaaggtaaggctggtgtaggagtgcttcgcggcgttgagaatatgtttaagaacttaaccaatccagctgttatctcaatgaataaggtcatcttaccagatgctagaaatgcttttgaaattaatgactttgaaggaaataaagcaattgtagtgattgctaatggtcaaaacggtgaagctcttcaagatttgcttaagattaataatcaaacttggactgataaatctggaaacaatgtaactggacgtcaaaattcagattatgtaacttacgttagagctgatgataattctaaccaaattggccaacgcggattgaatttcatctttactaacttagatgacttgcaccaatacttcaatcaagtaactaatgcagataatgttaaaaacgatattggcgaattgagtcatgattgggatgctcagcaagatactgataataatattgttaaaatcacattgcgtttgtctccggctagttcatatgatccatatagtgaaaatatccatgctgaaaaagatggcaatattttagcagacttaatgaccagcaaatatcaattacatattgttgctccaactaacactactgaaactaagaagccaaccagaacaattattattgaaaatcctgatggcaccacaagtactaaagagcaaactgtagagtttaagcgtgaagtcactaagcatgtcgatggtactgaagaggctacgtcatggactccaacaagtggtgaatggactaaatttgatgtgccacaaattgctggatatgattcttacgtagatggaactcagagcaagtctgttgcttcagaacctgttaataaagatactgagaatgtaactgtagtaattacttataagtcaaatgcggtaaatcctgaaccaatcattccagatccagtaaagccagaagttgatccggataaaaaagatccacaagaaccaaagacagatcctgtaactccaacaccagatgaaccagaaaatccaaagcctgaaaagaaaccaagtaatccagacaagcgtaaggatgataattctaaagttgttaagccacatggtgaaaataaagcagctaagaagaaccatagtagtgttgaacacaaaaagacaggtactcacactattaagctttctcacagagttgcaccaaagggcactcaagcaactaatggttcaaagaaatctacttcaactgtaaataaagcagctgacaacaataagaatactttgccacaaactggtgaaaagaagagcaatgccggcttaatcggcttagccttaattgcacttgcaagtttaggattaattgatcgtaaacgtcgtgat

SEQ ID NO: 188 - protein, 1382 aa, Lactobacillus acidophilus
MRRRCEMLSKNNFNEKLMQMNNQKAHFSIRKLTIGAASVLIGITFMGINGQTVNADEMTGNTQPEAMQVSTDKSTDATTTQQNDSDSSAQKNAAQTVEVPQNSKQDNTGETSQSTTDKKDTQVQKTESSETKADTAQSQVPPAANQTQKSADQNVENTQSPVASNTTQPKTQNDSKYNVADWGGSLNDETHEYTLNKYNGSDKENIYIPNTEDFIKAGKITDIDKVFITKDLIQNITKNGATSIVIDDQGSEDKNKVYAKGDWSNAFAGSTKLKSVDLSHLDTSQVTSMAGAFNGDTGLNDANLSGWNIQNMTNLSSLFYGANNLYNVDMSGWNFINNPNTNSMFSYADYNLKSVNLKNAKNVTDDILRIYARAIKNSNATTADLSDINLSPNVTSLHGLFSNMPDLKNVNLSGLDISHITDMGGMFSGDSNLESLDLSGLDLSKVTNTNNMFDWVGGKIKSVNITNTKSIPRSILDIYLKALSNTGTTTVDLSGINLSPNVTSLHGLFANMPNLGSANLSGLDISHITDMGGMFFNDTSLKSVNLSGLNLEKVKDLSTMFYGANNLENVDFSNTKFAPDANTNVMFAFADTKLQSVNINGTKNITREVLDAVIRAAKNSNATTLDLSGVSFSPSITSFNNLFSNMPNIESIDLTGWDTSHITDMSYMFFNDPKLKIIKGLEDFNTSNVTNMAYMFAAFNNPTTDNYDPKGLESLGHLTKLDLSNWDTSNVTNMLYMFAGQTNLTSLGDLSKWNTSKVTNMAYMFYDLKNIDDGKLDLTGWDTSNVTDMSYMFFNMFLQKDLSFVNDWNTGKVTDMSYMFANDKNLEKLDLSKWDVSSVGLKHTEQNYSLAMMFAGDTSLTTVGDISHWNTKNVHDTRQMFYNTPKLTNIDLSGWNTGKLQIAEGMFNSSGAKQINLDNWDLSNIKRITPAGYVEGKAGVGVLRGVENMFKNLTNPAVISMNKVILPDARNAFEINDFEGNKAIVVIANGQNGEALQDLLKINNQTWTDKSGNNVTGRQNSDYVTYVRADDNSNQIGQRGLNFIFTNLDDLHQYFNQVTNADNVKNDIGELSHDWDAQQDTDNNIVKITLRLSPASSYDPYSENIHAEKDGNILADLMTSKYQLHIVAPTNTTETKKPTRTIIIENPDGTTSTKEQTVEFKREVTKHVDGTEEATSWTPTSGEWTKFDVPQIAGYDSYVDGTQSKSVASEPVNKDTENVTVVITYKSNAVNPEPIIPDPVKPEVDPDKKDPQEPKTDPVTPTPDEPENPKPEKKPSNPDKRKDDNSKVVKPHGENKAAKKNHSSVEHKKTGTHTIKLSHRVAPKGTQATNGSKKSTSTVNKAADNNKNTLPQTGEKKSNAGLIGLALIALASLGLIDRKRRD

SEQ ID NO: 189 - DNA, 750 bp, Lactobacillus acidophilus
  misc_feature (0)...(0): ORF1741 - cell wall-associated hydrolase
  CDS (1)...(750)
ttgaatatttggacaaattatgaaaatggtaagtttatgggctatcgtgctaaagatggctctgtttggaatgtagctgcgacagctgtcgatagtaagggtaatctatggtataaagtagggacgcgtgaatggattgaagcgcgttataccgttgatgtcaatgaagcaactgaatctactaagacagctacgaagaaaaagacatcggtagctactttagctaataaagttaagaaaacaactacgaatgttaataaaaaaatttctgccgcattaaaagataataatacaaataagactaaagaagaaaaagttaaaaaggctaatcaaatcgttaatgagacagttaagaagaatgaagaaaataaaaattcttcaatgcaagcttcaagtaaagctgcttcaattgtagcccttgctaaagagcaggtgggtaagccctatgtttgggcagctgcaggacctgataaatttgactgttctggcttagttcaatatgtttaccaacatgctgcaggaattaatttacctcgtactacttatgatcaggttaaagtgggacaaacagttccacttaaccaacttcaagcaggggatttagtattttggggttctgagaccgctccatatcacgttgcaatttatattggtaataatcaatatgtcaatgcggctactcctgaacaaggaaccattttgcaaaatgtatctagttataatgagcctacaattgctaagagaatatta

SEQ ID NO: 190 - protein, 250 aa, Lactobacillus acidophilus
MNIWTNYENGKFMGYRAKDGSVWNVAATAVDSKGNLWYKVGTREWIEARYTVDVNEATESTKTATKKKTSVATLANKVKKTTTNVNKKISAALKDNNTNKTKEEKVKKANQIVNETVKKNEENKNSSMQASSKAASIVALAKEQVGKPYVWAAAGPDKFDCSGLVQYVYQHAAGINLPRTTYDQVKVGQTVPLNQLQAGDLVFWGSETAPYHVAIYIGNNQYVNAATPEQGTILQNVSSYNEPTIAKRIL

SEQ ID NO: 191 - DNA, 126 bp, Lactobacillus acidophilus
  misc_feature (0)...(0): ORF 1742
  CDS (1)...(126)
atggcagtaaagtttgctgcacggacagttttaagtgatgttattgcagaaacgcctgtaacagaaagcgctgcagccgctcccaatttaaataatttgtgctttgacataattcaatcctcttgg

SEQ ID NO: 192 - protein, 42 aa, Lactobacillus acidophilus
MAVKFAARTVLSDVIAETPVTESAAAAPNLNNLCFDIIQSSW

SEQ ID NO: 193 - DNA, 786 bp, Lactobacillus acidophilus
  misc_feature (0)...(0): ORF 1743 - cell wall-associated hydrolase
  CDS (1)...(786)
atgaatattaagaacaatttcgtaaaagttactgcagctgctgctttaactataaccggtgtggctgcagtaaatgctgttcaatcagattcaactactgctaatgttcaagctgccacaattaaagttacaattaattatgttccaggatatggtgttaacatctgggacaactacaatggcggtcacttcaccggccaacgtgcacaacacggtaccacttgggaagtgttagagcaaaagtttgattcaaagggccgtaattggtacaagattggggaaaataaatggattttagcacaatatgctacaactgatgctagtgctgcatcaactaagacagcaaatgcagctaccaagaagaccactaccaccactgctgcagctaataagaccaagaaggttaagaagtcagttcaagcaactggggatgcatcatcagttatcactttagcttctgctcaagttggtaagccttatgtttatggtgctcaaggtacagatagttttgactgttcaggtcttacttcatatgtttactcaaaagcagctggtgttaatattggtagaaccacttatgatcaagtaaagcaaggtactaccgtttcaatgaataaccttcaaccaggtgatttactcttctggggttcggcaagtgctccttaccatgtgggtatctatgtcggtaacaatcaatatattcatgcagctactcctggacaaggtgtagttaagcaaactatcagcacttatttctacccaagtgttgctaaacgtattttgaat

SEQ ID NO: 194 - protein, 262 aa, Lactobacillus acidophilus
MNIKNNFVKVTAAAALTITGVAAVNAVQSDSTTANVQAATIKVTINYVPGYGVNIWDNYNGGHFTGQRAQHGTTWEVLEQKFDSKGRNWYKIGENKWILAQYATTDASAASTKTANAATKKTTTTTAAANKTKKVKKSVQATGDASSVITLASAQVGKPYVYGAQGTDSFDCSGLTSYVYSKAAGVNIGRTTYDQVKQGTTVSMNNLQPGDLLFWGSASAPYHVGIYVGNNQYIHAATPGQGVVKQTISTYFYPSVAKRILN

SEQ ID NO: 195 - DNA, 552 bp, Lactobacillus acidophilus
  misc_feature (0)...(0): ORF 1744 - glycosidase
  CDS (1)...(552)
ttgattttcaaacgtactttggttaaatacacagcagctttatcaattttctttacaggtctttcagcagttagcgttccagcaactgttcacgctgacgatgttgaaaataccactactgttgacaccaacaactcagcttcatctattgaaaccagtacacctgaatcaaattcagtaaagaaggtttcagctacaacccaaaagcgtaacgctattgttaagcttgctaagaagcaagttggtaagccttacgtttggggtgctactggcccttacggattcgactgctcaggcttaactacttatgtttacaagaatgcagctaacaagactttaccaagaactacttacggtcaaattactatcggtaaatcagtatcagtttcaactaaatctcttaagaagggtgacttattgttctggggtaactcacacgtaggtatctacattggtaacggtaagtttgttcacgctccagctccaggtcaaaatgttaagactcaaactttagcatcattctacccatcagctgctaagcgtgttatcggt

SEQ ID NO: 196 - protein, 184 aa, Lactobacillus acidophilus
MIFKRTLVKYTAALSIFFTGLSAVSVPATVHADDVENTTTVDTNNSASSIETSTPESNSVKKVSATTQKRNAIVKLAKKQVGKPYVWGATGPYGFDCSGLTTYVYKNAANKTLPRTTYGQITIGKSVSVSTKSLKKGDLLFWGNSHVGIYIGNGKFVHAPAPGQNVKTQTLASFYPSAAKRVIG

SEQ ID NO: 197 - DNA, 447 bp, Lactobacillus acidophilus
  misc_feature (0)...(0): ORF 1745 - guanylate kinase
  CDS (1)...(447)
ttgacacatacgacgcgaccgatgcgagctggagaaaagcaaggtgtttcatatcattttgaaacagatgaaacttttaaccagctccatttctttgaacatattacttatggttcatatcaatacggctcaagtcgtgaagcattaaatctcgcttggaaaaagaacgacttagtctcattaattgttgatatcaaaggaatctattcttacattaatcagttgaaagataaggtatattttttatacattactacttcaactaaagaagaattaaaagagcgcttgttaaagcgaggagatgatcctgccaaaatcaaggaaaggcttagtggcagtgagttaaacgcattaccggaggacttaaagccttacgctcatgtattagttaatgatgatctatctaagactaagaatgcgctagatcagctggtagcaagctttcat

SEQ ID NO: 198 - protein, 149 aa, Lactobacillus acidophilus
MTHTTRPMRAGEKQGVSYHFETDETFNQLHFFEHITYGSYQYGSSREALNLAWKKNDLVSLIVDIKGIYSYINQLKDKVYFLYITTSTKEELKERLLKRGDDPAKIKERLSGSELNALPEDLKPYAHVLVNDDLSKTKNALDQLVASFH

SEQ ID NO: 199 - DNA, 297 bp, Lactobacillus acidophilus
  misc_feature (0)...(0): ORF 1746
  CDS (1)...(297)
atgaaaaaagcagatgtaaaagttggcgccattgttggtgctaagtcagaagaagaacttaagaagccgttccaaggtaaagtagaaaaaatttatgaaaactctgctcttttagcaattacttcatacgatccagttgataccaccgccgttagtgacctgaacaacaagatcgttgttaacttcaagaacttaaaggctgctcgcgccgctaaaaatagtaagactgcttcaactaacaaagttaaggttgaaaagatcgctaagaagaaagacgattcttcaaaagaagaaaaa

SEQ ID NO: 200 - protein, 99 aa, Lactobacillus acidophilus
MKKADVKVGAIVGAKSEEELKKPFQGKVEKIYENSALLAITSYDPVDTTAVSDLNNKIVVNFKNLKAARAAKNSKTASTNKVKVEKIAKKKDDSSKEEK

SEQ ID NO: 201 - DNA, 1509 bp, Lactobacillus acidophilus
  misc_feature (0)...(0): ORF 1747
  CDS (1)...(1509)
atgaaagaaaaaactagaactgtcttgtattggttcattcttattcagccatttctcgacctttattggttctacaatggtaaattagccaatattttgccatttactctgccaacaattatcaggattttagctgtttttgtaattttttgcatgttttttagccaaaagcaaaactggcaaaaattaggccaagaaaagtggctaatcgtttatctggctcttttgattatttactcgctcttgcacttaatccatgtcagacatttcaacagcgttaatccaagcgactacaactactctactgttagcgaagtattttacttaattagaatgcttatgccgctaatggtaattttctttaccaaagaattgaattttactcacaaacaatttagacaggtaatttcaggcattagcggtctattctcgttcaccatcgtgattagtaacttattcgtcatttcacttagaagttacgaaaccggctttattagtgccaatatctttgaatggttcattaaccccaacattggctattcgcacatggcttctaaaggtttcttcaactttacgaatatggtatcggcagttcttttcatgctcatgcctttaatgctctatttcatgttcagtcacttcaactggaggattgtcacactaaatattgttcaagctttagccatgattgaacttggaaccaaagttgccttgatcggcttaatcggtggcattattatcggtattttgctttatgtctttcatctatttattgttaaagatgttcaaaaaaatgggaaagctgtcctcgttgctcttttaatggaaaccggcacaattgcgatcattccttttggcccagcaattcagcgctacaattacgaaaaatatctagctcaacaatccgacaacagtttaactcaagctaaacaagaattagctcaaggattaaagaagtatcctactggaaaaaagcgcaaagaatttttaactgactttatcgaaaagcattatcaagattatgctttaaacaaaaaatttgtcactaagagctacccttataaatatgatccagaattctggcttaagatcatgaatgagccaggcacttctagaatggaaaaccgtcacgtcgaaaaggccatgctggatcaagtacttaagactaacaacaataaattagataaagttttcggtatttcctatactcgagaaactaatatctttaacttagagcgcgatttcactagccaggtctattcactggggtggctaggcatgttactcttcattgagccatatatagttatcctactctatgccgcaattaagtggttaatgaataaacaaaaacgtacatatttaattagctcaatgcttttgtcaattgctttcatgctctttgcagcatttttatcaggcaatgtcatggacttcttaactgctagctttatcttagcttttgctgaaggaagtttgcttagcgaagttactcgaaaaaagacggaa

SEQ ID NO: 202 - protein, 503 aa, Lactobacillus acidophilus
MKEKTRTVLYWFILIQPFLDLYWFYNGKLANILPFTLPTIIRILAVFVIFCMFFSQKQNWQKLGQEKWLIVYLALLIIYSLLHLIHVRHFNSVNPSDYNYSTVSEVFYLIRMLMPLMVIFFTKELNFTHKQFRQVISGISGLFSFTIVISNLFVISLRSYETGFISANIFEWFINPNIGYSHMASKGFFNFTNMVSAVLFMLMPLMLYFMFSHFNWRIVTLNIVQALAMIELGTKVALIGLIGGIIIGILLYVFHLFIVKDVQKNGKAVLVALLMETGTIAIIPFGPAIQRYNYEKYLAQQSDNSLTQAKQELAQGLKKYPTGKKRKEFLTDFIEKHYQDYALNKKFVTKSYPYKYDPEFWLKIMNEPGTSRMENRHVEKAMLDQVLKTNNNKLDKVFGISYTRETNIFNLERDFTSQVYSLGWLGMLLFIEPYIVILLYAAIKWLMNKQKRTYLISSMLLSIAFMLFAAFLSGNVMDFLTASFILAFAEGSLLSEVTRKKTE

SEQ ID NO: 203 - DNA, 618 bp, Lactobacillus acidophilus
  misc_feature (0)...(0): ORF 1748
  CDS (1)...(618)
atgtttagctggaatattattgggatcctaatatgggtcgctatcattctttatttagtctttatcatccaaaacattcgtaaacgtcgaattaagatgattattaaacaacataaacgctttagttggcctaactttttacttaatgcaattgaaattgtcattttattagttgctgctggttggatgtttaatcagacctttatggataatccagatttagaagatgccaatcgcattacttcaacggttaaatatgatccgttaattatgaatactgggactggtaattctagttatgtgacaattaattcagctaagaagaaatatggttcacagacttatactttttatcgagcaggaagtaaaataactgcgtcaagcgattatgcgtcaattgcatatggaaacacttctttagatgttaatgctgagaaaatcccgtatgttaaaaaagaattggcgaagatggacaagaaataccaacgtgcttatgttgctgtttatacagctaaatataagaaaaattggcaaaatggaatagggatgcatgcaggtcatttagctacgcgctattacttgattcgcattccagatgcaagttttattaaacagaag

SEQ ID NO: 204 - protein, 206 aa, Lactobacillus acidophilus
MFSWNIIGILIWVAIILYLVFIIQNIRKRRIKMIIKQHKRFSWPNFLLNAIEIVILLVAAGWMFNQTFMDNPDLEDANRITSTVKYDPLIMNTGTGNSSYVTINSAKKKYGSQTYTFYRAGSKITASSDYASIAYGNTSLDVNAEKIPYVKKELAKMDKKYQRAYVAVYTAKYKKNWQNGIGMHAGHLATRYYLIRIPDASFIKQK

SEQ ID NO: 205 - DNA, 444 bp, Lactobacillus acidophilus
  misc_feature (0)...(0): ORF 1749 - nrdl ribonucleotide reductase
  CDS (1)...(444)
atggtagcaatagcattttattcaataactgggcaaactgaacgttttattgataaaatacagttaaaagcccatcaaatcagcgatgccaaccctaagtatgacatggggcaaaaatatattttaattgtcccttcatatcaggactttatgatggattccgttgttgattttttgacgtataaagataataagaaaaatatcattggaattataggttgtggcaatcgaaactttaacgacctttttgctcaaactgctaaaaagatcgcagcaactttaaaagtacccattctttatctgttagaatttagtggtactaatcaagatgttaaaaatgtccgtaaaattgttcatgatctttctgcaggacagagtaccaaagaggttcaaaagccgaaagaattacgtggaaatattagctttttgagtgattatagagat

SEQ ID NO: 206 - protein, 148 aa, Lactobacillus acidophilus
MVAIAFYSITGQTERFIDKIQLKAHQISDANPKYDMGQKYILIVPSYQDFMMDSVVDFLTYKDNKKNIIGIIGCGNRNFNDLFAQTAKKIAATLKVPILYLLEFSGTNQDVKNVRKIVHDLSAGQSTKEVQKPKELRGNISFLSDYRD

SEQ ID NO: 207 - DNA, 933 bp, Lactobacillus acidophilus
  misc_feature (0)...(0): ORF 1750 - ribonucleotide reductase
  CDS (1)...(933)
atgacaaagaaatattacgaagcaataaattggaatgacatggaggataaagtagataaatccgcttgggctcggttaaatgatatcatttgggagccacgtcatgttccagtaaaagaagacaaaaaagaatttttacaattacccagtcctgtaagatgtacacttcttcatgtgtttagcgctctttcattttcatctggtttacaaatgaaaagcggtattgagcaaattaaggtagacgcaattacgcctgaagaagcagcagtcttaaatgcattacagtatttggaatcaattgctaataagagttacagctatgtcttacgtgaattggctactccagaagaagttgataatgcatttgattgggctaacaatagtccttatttgcaaaagaagattcacattttgaataaaatttatcaacgtggggatgccttgcaaaagaaagctggcaatgtaattttggaaacagctctttatcattcaggcttttttgctccactttacctatttgggcaaggcaagatggttagaactgctgaaattatcaaattagctctacgcggcacatcattcagtggtatttatcctggttataagttccgtcttggctataaaaagttaggcaaaaccgaacaagaggaccttaagcattggattgataacttgtatgatgaacttgtgaaaaacgaagaaaaacacatcagattactctacaaagggacaggttggactgaagatgctttacactacatgtattatagtgtaaataaagcttacttaaacttaggattcccagggaaatatcctgatacatcagacacaatcaatccagttcttgaacaaggtgtaattaaaagtgcggtatttgaagatttcttctactacactaatgatcacagcttaaataaattcaaagaaattaag

SEQ ID NO: 208 - protein, 311 aa, Lactobacillus acidophilus
MTKKYYEAINWNDMEDKVDKSAWARLNDIIWEPRHVPVKEDKKEFLQLPSPVRCTLLHVFSALSFSSGLQMKSGIEQIKVDAITPEEAAVLNALQYLESIANKSYSYVLRELATPEEVDNAFDWANNSPYLQKKIHILNKIYQRGDALQKKAGNVILETALYHSGFFAPLYLFGQGKMVRTAEIIKLALRGTSFSGIYPGYKFRLGYKKLGKTEQEDLKHWIDNLYDELVKNEEKHIRLLYKGTGWTEDALHYMYYSVNKAYLNLGFPGKYPDTSDTINPVLEQGVIKSAVFEDFFYYTNDHSLNKFKEIK

SEQ ID NO: 209 - DNA, 531 bp, Lactobacillus acidophilus
  misc_feature (0)...(0): ORF 1751
  CDS (1)...(531)
ttgaagattaatttaaaagatttaaatgataaaattaaaaatcaagattacatccaagatcttgagacagttaaatatgctgatataagtaaatctaaaagcaaaatcaaaccatatgcagaaaagatgattaaagaagttttggctgcatataagcatgattcactggtacaaacccagttagcagtgattggtcagcgtccagttacctttgcattagagacgaatattattaacttgccttatgctaattataagaaaattgctaatttctttgaagaaggtcaagaatatccgatcaatgtttattttgagacacgttcagaatatgtgaatgtatctggctttagaattgatcaacttgctagcgaagaagaagttgaaaaagatagcagtgcaattgttgataagttagttgaagcaattattgaaaaattgaccgtagtccgtgaatataaaaagcctgaaaaaactaaaactgaaagtaaggaaaagacgacaactactaaaaagaaaacgacaactaagaag

SEQ ID NO: 210 - protein, 177 aa, Lactobacillus acidophilus
MKINLKDLNDKIKNQDYIQDLETVKYADISKSKSKIKPYAEKMIKEVLAAYKHDSLVQTQLAVIGQRPVTFALETNIINLPYANYKKIANFFEEGQEYPINVYFETRSEYVNVSGFRIDQLASEEEVEKDSSAIVDKLVEAIIEKLTVVREYKKPEKTKTESKEKTTTTKKKTTTKK

SEQ ID NO: 211 - DNA, 720 bp, Lactobacillus acidophilus
  misc_feature (0)...(0): ORF 1752
  CDS (1)...(720)
atgaacaacatgaaacacaaaaaaactaattacaaatatttatatataattattccaacagctttaatcctcgttatgggcttagcttatatcctagttaaaaataaaattgataatgaatttaactggatttcaatgaaagaagaacaaaagttaaatgtgcccattgaaaatcaaatgccagatttacctaacggctgtgaagtaactagtttatcaatgctaatgaattattatggcattagagtaactaaaaatgaattagctcaaaatatccagcatgtcagttcctttaccaataatggtaaatatagaggcaatccaaatcaaggatttgttggttatatgtccattgaaaatgcaggatggtgtgtttataatgggccgctttataacgttgcacgtaaatatactaaccgtattcaaaatgcaacagggagcgattttttaagtatattaaagctcgtatcagatggtcatccggttttgattattactaccactacttttaatcgtgttaataatatgcaaacttgggaaactaacaccggaaaagtaaatgtaactccatcttctcatgcctgcgtaattactggttatgacaagaaaaaaaggattgtttatttaaacaatccttatggtattaaaaatcaagctgtcaattggaataatcttgaaaatagctataatcaacaaggcaaacaagcattatacattaag

SEQ ID NO: 212 - protein, 240 aa, Lactobacillus acidophilus
MNNMKHKKTNYKYLYIIIPTALILVMGLAYILVKNKIDNEFNWISMKEEQKLNVPIENQMPDLPNGCEVTSLSMLMNYYGIRVTKNELAQNIQHVSSFTNNGKYRGNPNQGFVGYMSIENAGWCVYNGPLYNVARKYTNRIQNATGSDFLSILKLVSDGHPVLIITTTTFNRVNNMQTWETNTGKVNVTPSSHACVITGYDKKKRIVYLNNPYGIKNQAVNWNNLENSYNQQGKQALYIK

SEQ ID NO: 213 - DNA, 315 bp, Lactobacillus acidophilus
  misc_feature (0)...(0): ORF 1753
  CDS (1)...(315)
atgattggagaaaaaatgagcgataaagaaaaggaaatttataacgctttaaaaacagtaatagatcctgaattaaccgtaaacttagtagatttagggttcatttatgatattcaggttgaagataggactgcaataatcaaaatgactttaacaattatgggttgtccgctaactgagcttttgaataaagagatcactaccgcagtcacttttgttcctcaaatcgaaaagtgcaaaatcaacttagtttggtatcctcaatggactccagataagatgagccgtgcagctagactcatcttaggaatacat

SEQ ID NO: 214 - protein, 105 aa, Lactobacillus acidophilus
MIGEKMSDKEKEIYNALKTVIDPELTVNLVDLGFIYDIQVEDRTAIIKMTLTIMGCPLTELLNKEITTAVTFVPQIEKCKINLVWYPQWTPDKMSRAARLILGIH

SEQ ID NO: 215 - DNA, 294 bp, Lactobacillus acidophilus
  misc_feature (0)...(0): ORF 1754
  CDS (1)...(294)
atggtgaaggcgcacgttgaatgcgatacgattatcatggacgatatgtcttcttctgataccattcctacaaattcaattgaaaactctaatgttgctatggaacatgaggcaactgtatcaaaaatttctgaagaagagctgtattatttgcaaagccgtgggattccagaaagaaaagccactgaaatgatcattatgggatttgttgaaccgtttactaagcaattaccaatggaatatgcagttgagttaaatcgtttaattagtttccaaatggagggagcaattgga

SEQ ID NO: 216 - protein, 98 aa, Lactobacillus acidophilus
MVKAHVECDTIIMDDMSSSDTIPTNSIENSNVAMEHEATVSKISEEELYYLQSRGIPERKATEMIIMGFVEPFTKQLPMEYAVELNRLISFQMEGAIG

SEQ ID NO: 217 - DNA, 228 bp, Lactobacillus acidophilus
  misc_feature (0)...(0): ORF 1755 - abs transporter
  CDS (1)...(228)
atggccgttttagaaattaaagatttgcatgttgaagtaaaagataaagaagaaaatacacagaaaaaaatcttaaaaggtataaatttaactcttaaaactggagaaattcacgcaattatgggacccaatgggacgggtaagtctactttatcagagacgattatgggcaatcctaaatatcatgttatacaaggcaaacttcttttaaatggtgaaggcgcacgt

SEQ ID NO: 218 - protein, 76 aa, Lactobacillus acidophilus
MAVLEIKDLHVEVKDKEENTQKKILKGINLTLKTGEIHAIMGPNGTGKSTLSETIMGNPKYHVIQGKLLLNGEGAR

SEQ ID NO: 219 - DNA, 156 bp, Lactobacillus acidophilus
  misc_feature (0)...(0): ORF 1756
  CDS (1)...(156)
gtggcaagtacgggaagtactgatgttggacatactgatgtgaacagtttaatgtccacatatgctttatgcatgtgccttgagtttttgtcaatgaatattgataaagatatgaagaaccaaacagtaatatatattgctgtttggttctttttt

SEQ ID NO: 220 - protein, 52 aa, Lactobacillus acidophilus
MASTGSTDVGHTDVNSLMSTYALCMCLEFLSMNIDKDMKNQTVIYIAVWFFF

SEQ ID NO: 221 - DNA, 483 bp, Lactobacillus acidophilus
  misc_feature (0)...(0): ORF 1757
  CDS (1)...(483)
atgccattttggttagaagttgtaattaatgttgcgttttcttatctagcttcagttggctttgctctaacaattaatgtgccgcatcgtgccttaaatttgtccggaattagtgggacagttggctggatggcttattggttttgttttcgtttaggtgctggtcgaatggcatctaatttaatcggtgcatttttgattggaattttgggtttagtttttgccagaataaaaaagtgtcccgtaacagtgtttaatattccagctttggttccattggtgccagggatgcctgcgtatcaggcagttcgagcgtttgtagttggagattatattcaaggtcaggaactaattttgcgtgtagcaattgttacaggcgcaattggcttaggcttcttactttcaaccatgtgtacagaagctttttataagataagatatcgtcattttagaaacacaggactgtactttaagcggaaaaaa

SEQ ID NO: 222 - protein, 161 aa, Lactobacillus acidophilus
MPFWLEVVINVAFSYLASVGFALTINVPHRALNLSGISGTVGWMAYWFCFRLGAGRMASNLIGAFLIGILGLVFARIKKCPVTVFNIPALVPLVPGMPAYQAVRAFVVGDYIQGQELILRVAIVTGAIGLGFLLSTMCTEAFYKIRYRHFRNTGLYFKRKK

SEQ ID NO: 223 - DNA, 768 bp, Lactobacillus acidophilus
  misc_feature (0)...(0): ORF 1758
  CDS (1)...(768)
atgtctgataagcgggatgctcgattttatcaagaggtattagacatttgtttaactgcaggtcgtctgatgattgaaggcggaagcgaaatgtatcgagttgaagataccatgctcagaattgctagaaacgcggatattaatgatccacgcgtttttgcgacaccgacttgtgtatttatgagccttgatgggggaaaattatctcagatgaagcaaattcgtgatcgaaatatcaatttagagttggttgatcgcgtaaatgaattatcaagagaatttgctactaaaaaaattgatttatcagaattgaaaaatcgcattattgaggttgctaatgcaccatcatttccaatgtggatgcagataattggtgcggccgtacttagtgccaccttgatggttttatttatggatgattatgattgggtagattttcccggtgcagctcttgtaggagcaattggcttttgggcatattatgaatttaaaaagtatactaaagttcgatttttgtcggaattaatcgctgcaatgataatgggggtcttggcacttggcttaaattatctttatccaaaaatgattatcgataatattctaattggtgcattgatgactttggtgccggggttagcgatgacgaatgctttgcgcgacctttttatgggggatctgctgtctggcatcgttagaatgtgtgaggccattttaagtgcattagctttaggtggtggcgtcggtctggttttgaagtttgtgggagga

SEQ ID NO: 224 - protein, 256 aa, Lactobacillus acidophilus
MSDKRDARFYQEVLDICLTAGRLMIEGGSEMYRVEDTMLRIARNADINDPRVFATPTCVFMSLDGGKLSQMKQIRDRNINLELVDRVNELSREFATKKIDLSELKNRIIEVANAPSFPMWMQIIGAAVLSATLMVLFMDDYDWVDFPGAALVGAIGFWAYYEFKKYTKVRFLSELIAAMIMGVLALGLNYLYPKMIIDNILIGALMTLVPGLAMTNALRDLFMGDLLSGIVRMCEAILSALALGGGVGLVLKFVGG

SEQ ID NO: 225 - DNA, 1539 bp, Lactobacillus acidophilus
  misc_feature (0)...(0): ORF 1759 ATPase component of ABC transporter
  CDS (1)...(1539)
atgagtttattaactgttaaagatttaggtcagagttttattgataagaccttatatgaagatgctaactttgtgttaaacaaagaagaccacatgggagttaccggacaaaacggtgtcggcaaatctactttaattaagattttgactggtgagatcttgcctgataatggtcaagtaaaatggcaaaacaaaattgatgtgggttatttagatcagtatgctaaattagcaccaggtgtgactatccgcggatttttacgtacagcctttgatgatttattccaaaaagaaaaagaattaaatgagctttacactaaatacgctgaaactagtgatgaagatctacttgaaaaagcgggcaaggtgcaaacttatctagaagaaaataatttctacgatattgatactgaaattgaacaagtcgcatctggtttgggcttagctgacttaggctatgaccatgacgtttcaaaattatcaggtggtcaacgctcaaagattattttgggtaaattattattacaaaatccagatgttttagtattagacgagccaaccaactaccttgatgtgtcacatattgattggctagttgattatttgaataattttgaaggtgcctttatcgttgtcagtcacgattacgatttcttaggtagaatcactaactgtattatcgacatcgactttggtacgattacgcgttataccggtaccttaaagcaagcgatgcgccaaaaagctgctaaccgtgaaacttaccttaaagcctatgctaaccagcaacgcaagattgctaagactgaagcatatattcgtaagaataaagctggtacgcgtgctaagagtgcaaaatcgcgtgaaaagcaattagctagaatggacgttttaactccgcctaaaaataatcgtcgggccaagttcgaatttccatatgtagcaactgcttccaatttgcttttgcaaacgcaagacttggttattggttatgatcaggctttagttaagtctgcatttaacttctcagttggcggtgatgaaaaagtagcaattaccggtttcaacggaatcggtaaaactacccttcttaagactcttttaggtcaattaaagccgatctatggttcatatgacttgtcagttactgctaagcttgcttattttaagcaggatttaacatggcctaacaacaatatgacaccgctacaatacttgcaagaagaatttgaacgtaaaaagccaaaggaattgcgtcaagccttagctagaatgggattaactgcgcaacaagcaatgagtccgttaaaggagctttccggtggggaacaggaaaaagtaaaattagctaaaatgcagtttgagccagctaacttgctctttcttgatgaacctactaaccacttggataacgatactaaggatgcattgcgcaaggcgattatcaatttctcaggtggagtaattattgtaagtcacgaacgcgacttcttccgtggtgactggattgataaaacaatcgatattgaaacaatgaat

SEQ ID NO: 226 - protein, 513 aa, Lactobacillus acidophilus
MSLLTVKDLGQSFIDKTLYEDANFVLNKEDHMGVTGQNGVGKSTLIKILTGEILPDNGQVKWQNKIDVGYLDQYAKLAPGVTIRGFLRTAFDDLFQKEKELNELYTKYAETSDEDLLEKAGKVQTYLEENNFYDIDTEIEQVASGLGLADLGYDHDVSKLSGGQRSKIILGKLLLQNPDVLVLDEPTNYLDVSHIDWLVDYLNNFEGAFIVVSHDYDFLGRITNCIIDIDFGTITRYTGTLKQAMRQKAANRETYLKAYANQQRKIAKTEAYIRKNKAGTRAKSAKSREKQLARMDVLTPPKNNRRAKFEFPYVATASNLLLQTQDLVIGYDQALVKSAFNFSVGGDEKVAITGFNGIGKTTLLKTLLGQLKPIYGSYDLSVTAKLAYFKQDLTWPNNNMTPLQYLQEEFERKKPKELRQALARMGLTAQQAMSPLKELSGGEQEKVKLAKMQFEPANLLFLDEPTNHLDNDTKDALRKAIINFSGGVIIVSHERDFFRGDWIDKTIDIETMN

SEQ ID NO: 227 - DNA, 372 bp, Lactobacillus acidophilus
  misc_feature (0)...(0): ORF 1760
  CDS (1)...(372)
atgcaaaaaaaagaatctatatttccggttgtctatggcgtaatttctgccattatttcctttattgcagccatgtttatttgcttacgtagttttagattgaacttacaagtatcgattatcgttgcaggtatttttgcaattttcttcttcggcctgtcttattttagaggacatgcatcagtcgaaattaagcgaattgtttataaatataagctgacagatcaagaattagccaaaattacagggatgaaagctagcgatttcccaatttatcatgatcgcttgcaattaattttacctaaaagatattggccacgggttcttgatgcactccaaaaatacgaaaaagagcgtgagtcggcaggggag

SEQ ID NO: 228 - protein, 124 aa, Lactobacillus acidophilus
MQKKESIFPVVYGVISAIISFIAAMFICLRSFRLNLQVSIIVAGIFAIFFFGLSYFRGHASVEIKRIVYKYKLTDQELAKITGMKASDFPIYHDRLQLILPKRYWPRVLDALQKYEKERESAGE

SEQ ID NO: 229 - DNA, 219 bp, Lactobacillus acidophilus
  misc_feature (0)...(0): ORF 1761
  CDS (1)...(219)
atgaaaataaaaaagattaattttaaaataaatgatttaaaaatcgaattagttaaaccacaaattgaacacgcaacagatctttatcaagctattaaacatgatcaaaaaagcctaagcaaatggttaccttgggcttatgacattaattcaattcaagctgaggctaattttattaaacagattcagaaaaaagaagaaattattgctctaactatt

SEQ ID NO: 230 - protein, 73 aa, Lactobacillus acidophilus
MKIKKINFKINDLKIELVKPQIEHATDLYQAIKHDQKSLSKWLPWAYDINSIQAEANFIKQIQKKEEIIALTI

SEQ ID NO: 231 - DNA, 1272 bp, Lactobacillus acidophilus
  misc_feature (0)...(0): ORF 1762
  CDS (1)...(1272)
atggatccaaattccaaacgtagagaagattatcgcaaacattcatcattaaatcttcatcgcaatcatgctttggcagcagattcttcatcttttaaagccggtaacatgtttgctcgttttattggggtgatcgcgttattaaccgtttgtttcggtgtggcatgggctgctcatatgtatttcacaattcatagtgcagttgatggtaaaaataatggtaatgttgcgacatccgctaaaatttcgactagacaaccagtttcagtattgattttgggagtcgatcaaggaattgaaggccgtcatgaccgaggtaactctgatactttaattttagcaacagctaatccgcaaaaaaataaggcaacgatgacatctattccacgtgatacattggctgatattaaaggtgatccaggtgacaaatacttcatgtttagggttaactcagcttatgaaatcggtggtagtgaagcaagtatgaaaactgtctcaaatatgttaaacgtaccgataaactattatttagaagttaacatgaaggcgctgcgcagtttagttaacgcagtgggcggcgttgatgtaaatgtgcctttcgatttctcatatgattggtgtgacttccacaagggtaagcaacacttgaatggtcggcacgcagttgcttatgtccgaatgagaaaagaagatccgcgaggtgactatggtagacaactccgtcagcgtcaagtaattgaagcaattgctcataaggctatgtcagttaatacaattagtaactatcgtaaattaattgatatttttaacaaatatgtcaagactaacttaacttttaacgatatgctcagtttagctcttaactaccgtggttgtatgggtaatttagatagtggctatattcaaggtcatgatgcttggattgacggttcgtcaattcaagtagccccaactgcagaattacaaaaaatttcaaataagctcagaaagaatctgaatttaccggctgaaacacttgataatgaagaaactcgtcaaaatgatttgaatgatcaaaataaccatgtaaaatgggatgatcctcaggcatttactacttatcgtatttatgagcaaaatgcagataagccagcgggcggttcaaattcaggctatggtgaaaataaagataccaattcaggtagttcaaccacttcctctagtatgtcgagttcatcggactcattaggtagctcatcttcgtctagtagtaagacttggaaatttcattgg

SEQ ID NO: 232 - protein, 424 aa, Lactobacillus acidophilus
MDPNSKRREDYRKHSSLNLHRNHALAADSSSFKAGNMFARFIGVIALLTVCFGVAWAAHMYFTIHSAVDGKNNGNVATSAKISTRQPVSVLILGVDQGIEGRHDRGNSDTLILATANPQKNKATMTSIPRDTLADIKGDPGDKYFMFRVNSAYEIGGSEASMKTVSNMLNVPINYYLEVNMKALRSLVNAVGGVDVNVPFDFSYDWCDFHKGKQHLNGRHAVAYVRMRKEDPRGDYGRQLRQRQVIEAIAHKAMSVNTISNYRKLIDIFNKYVKTNLTFNDMLSLALNYRGCMGNLDSGYIQGHDAWIDGSSIQVAPTAELQKISNKLRKNLNLPAETLDNEETRQNDLNDQNNHVKWDDPQAFTTYRIYEQNADKPAGGSNSGYGENKDTNSGSSTTSSSMSSSSDSLGSSSSSSSKTWKFHW

SEQ ID NO: 233 - DNA, 1614 bp, Lactobacillus acidophilus
  misc_feature (0)...(0): ORF 1917 - polysaccharide transporter
  CDS (1)...(1614)
ttgaataaaaaaatcctgtccggttcattttggctatcatttggtagtatcgtctctagaattctaggagttgtttatttaattccatggcttatcatgcttggcagctaccataatcagctaaatgcgcaggcgttattcaattcatcttatacgccatatgcgcttttcttatctattggtactgcgggcttaccttcagttattgcccgggaagtatcacaattaaattctcagaatagatataaagacagcctatatattacaaaattaggcttaattatcatgcttgtaatgggattagcatgtggtattttgttatacgctactgctcctataattgctaagaatagtccagtagattcagtagctagtgctactatttctatccgcgtattggttccagctgtaattattttgccatcaatgagtatggtaagaggatggtttcaggggaacaacgatatgaagccatacggcatttcccaattatgggaacaatttgcgcgcattctatttattcttttatctactttattagtgatcgaagtttttcatcataattatgtgacagcagtttattttagtgtattcggtgcatgtgtgggtgctattgccagttatttgtatctttttgcgtatatgcgcaagaagtggggatactataaggggttaattgaaaaaagtaaaccacgggctttaaacaatgtttatcgaagcttgcttaatctttggtatgcatcaataccatttgttttacttggttcattcattactgttacgcaattagttgatcaacttttattcaagcagattttgattagttttaaccatatgagtagccaatatgtgagctatttgtataccatattttcagctaatccaagtaagatcaccacagtaataatttctcttgctacagcagtttctgagactagtttgccacttttagctggtcttaagtataagtccaaggataatcaaggaagcattaaaaagctgcttttagagaactatcgccttcttctttttgtattacttccgttagtgtcacttgcagcatttgcttcttcgccaatttatacagtactattttctcatgatagtttgggtgcttattatttggtggaaaacattgtacaaagtctattagccggccttgtgatgaactcattaactttgcttctagcacttaatatgaacaaattggctgttggttatatgatttggggaattattgtcaagattgtattacaggttcctatgacgatgtttatgagtgcagatggtgcaattctttcaactgatattgccttcttacttgtaatcgtgcttagttatcataagcttgataaaacatatgatgttaacttgcatagcttgctgccgattgttgtagtaaatgaaatctacattatcttattatttatttaccaacttttaattggatatcatttcaatagtttaggaagaatgggaagcttcatctatttagcaatcttcggtttagtattcctaggaatttatatcttacttgctaatgtaatggggactagcgagacaatttttggcaaaaagatcggttaccgctattatcgttataaacattttgaa

SEQ ID NO: 234 - protein, 538 aa, Lactobacillus acidophilus
MNKKILSGSFWLSFGSIVSRILGVVYLIPWLIMLGSYHNQLNAQALFNSSYTPYALFLSIGTAGLPSVIAREVSQLNSQNRYKDSLYITKLGLIIMLVMGLACGILLYATAPIIAKNSPVDSVASATISIRVLVPAVIILPSMSMVRGWFQGNNDMKPYGISQLWEQFARILFILLSTLLVIEVFHHNYVTAVYFSVFGACVGAIASYLYLFAYMRKKWGYYKGLIEKSKPRALNNVYRSLLNLWYASIPFVLLGSFITVTQLVDQLLFKQILISFNHMSSQYVSYLYTIFSANPSKITTVIISLATAVSETSLPLLAGLKYKSKDNQGSIKKLLLENYRLLLFVLLPLVSLAAFASSPIYTVLFSHDSLGAYYLVENIVQSLLAGLVMNSLTLLLALNMNKLAVGYMIWGIIVKIVLQVPMTMFMSADGAILSTDIAFLLVIVLSYHKLDKTYDVNLHSLLPIVVVNEIYIILLFIYQLLIGYHFNSLGRMGSFIYLAIFGLVFLGIYILLANVMGTSETIFGKKIGYRYYRYKHFE

SEQ ID NO: 235 - DNA, 813 bp, Lactobacillus acidophilus
  misc_feature (0)...(0): ORF 123 - EpsV
  CDS (1)...(813)
atgttacaagtgcctaagttaactatcattatgccggtttacaacacggcacaatatctgccacgcgcttttgatgctttacttaagcaaatcgacaaaagctttaagttgatcgtggttgatgatggctcaactgataattcagttgaggtagcccaaaactatgcctatcgctttccatattttaaattaattaaaaagaaaaatggcggcccatctgatgcacgtaatgttggtatgcagtatattgacacgccatatgtcacctttcatgatggtgatgactgggtggatccaggctatacgtctttttttattcgcgcttttgaagaacatcctgatgtaaatcttgtttcttgtggatattggatggactatccagataaaaagtcacgtgttgttggacgacctgaaggcggttttttaacgcggggtgaaacttatctaaaattaaccaatgtttttggttcgccaatgaaaggctatagttggaataaagcttataagacagcaattattaaaaaattccatttacaatttgatcgcgatatttcactacttgaggatcaaatttttaatgtgaaatatatttctgtagctaaaggagtttattatactcagcgtccttactaccattattggcaaagaaaaggaagtattattcatcaacctaatgttaaaaaggtagccgataatttccgtggtaattatcgagtatggcgcagaattattaagacgatgcttaaagatcatgaagatgagaagatgcgtaaaaaattagatcgttcacctcttcgtgatagcgatgttcaa

SEQ ID NO: 236 - protein, 271 aa, Lactobacillus acidophilus
MLQVPKLTIIMPVYNTAQYLPRAFDALLKQIDKSFKLIVVDDGSTDNSVEVAQNYAYRFPYFKLIKKKNGGPSDARNVGMQYIDTPYVTFHDGDDWVDPGYTSFFIRAFEEHPDVNLVSCGYWMDYPDKKSRVVGRPEGGFLTRGETYLKLTNVFGSPMKGYSWNKAYKTAIIKKFHLQFDRDISLLEDQIFNVKYISVAKGVYYTQRPYYHYWQRKGSIIHQPNVKKVADNFRGNYRVWRRIIKTMLKDHEDEKMRKKLDRSPLRDSDVQ

SEQ ID NO: 237 - DNA, 1428 bp, Lactobacillus acidophilus
  misc_feature (0)...(0): ORF 525 - EpsU
  CDS (1)...(1428)
ttgcgcaaaacatttttaaatattttgtataatgcggtttatcagatctttattgtattagttcctctgattaccgttccatatctatccagagttttgggacctaagacatatggtatttatagtagcgttaataacactgtacagtttttgatgattttttgtatcctttctgtgtcttatgtggggatgcggacgatttcaagaacgcgtacatacggaacacaggaagaattaactagagcattttggggcttgtggtattttcaaggtattgctggcgcaattacgattgtaattactattttagtaactactatttttcatattcaatactggttttaccttttacttatggtgccatacttaatttctgctcaggtagatatttcttggtttttccaaggattagccgactttggtagagttgttttaaaaaatactgctgtaaagctggttagtgttgttttaattttgctatgggtaaaatcaccagcagatttgtggaaatatttactgattatgtctgtttctacaatgctaggttcttttgtcttttggtttgatattcaccgttatgtgggtcgaccagtagcgcatttttataaatttaagaagaatgctattgcgattggaactttaatgattccgcaaatcgctacccaaatttatacatcattagataagccaattttgggtcttttttcaagttctacccaagtttctttttatgataattcacagcgaatttctaatatgattttaggagtaattactagcatttccttggtaatcatgcctaaaatggccagtgaagatgaagaatcacaaaaggttgtgatgaaaaagtcgctagaagctacagtgatgctaggaactttatttgctgtaattattatggcaaatactaaacaattcgtaccattcttttttggcactaaatatattccgatgacaccgttgatgttttggttcactttgactattatcatgattccaaccggtggtgtttttgccaatcaatttgccctagccaatagacgtgataaggattatgcttttcctgtagttattggtgcaattttagaaattattttaagttatgttctagatcggccgtatggtgcagcaggtgcgatgattgcaattttaattacagaagccgtagtattagttctacgtttatgggttgtgcgtgacggctatagttttacatatgtttttcacgatgttcctaaatatattttaattgcattaatcactcttaccattgggatgtttatgcctaactttatttcatcggcctttttcaatatggcatttaaatcaattgtgatgttgctagtttatatgcttttgatgtttgcattaaagctcgactttaacgaagacattattaaattattcaagaatttctttaaaagaggt

SEQ ID NO: 238 - protein, 476 aa, Lactobacillus acidophilus
MRKTFLNILYNAVYQIFIVLVPLITVPYLSRVLGPKTYGIYSSVNNTVQFLMIFCILSVSYVGMRTISRTRTYGTQEELTRAFWGLWYFQGIAGAITIVITILVTTIFHIQYWFYLLLMVPYLISAQVDISWFFQGLADFGRVVLKNTAVKLVSVVLILLWVKSPADLWKYLLIMSVSTMLGSFVFWFDIHRYVGRPVAHFYKFKKNAIAIGTLMIPQIATQIYTSLDKPILGLFSSSTQVSFYDNSQRISNMILGVITSISLVIMPKMASEDEESQKVVMKKSLEATVMLGTLFAVIIMANTKQFVPFFFGTKYIPMTPLMFWFTLTIIMIPTGGVFANQFALANRRDKDYAFPVVIGAILEIILSYVLDRPYGAAGAMIAILITEAVVLVLRLWVVRDGYSFTYVFHDVPKYILIALITLTIGMFMPNFISSAFFNMAFKSIVMLLVYMLLMFALKLDFNEDIIKLFKNFFKRG

SEQ ID NO: 239 - DNA, 1101 bp, Lactobacillus acidophilus
  misc_feature (0)...(0): ORF 188 - EpsA
  CDS (1)...(1101)
atgaaggataacagagaaagagaaaatcacccgagcggtactcgagtgcaaagtcataaatataaaaatcgacatatttgggcgtgggctacagggataattttattagttgcagtcattgcggcagtaacatactttgcatctgtttattttaaggcgaagaatgcagttgataaaacctatgatccagctacagcagtgaaaactacaggtgaatttaatggcaaaaagcgttttgcggttctattaatgggaacagacacaggggctttaaatagaactgagaaacgcggtagaactgataccatgattttagctgtagttaaccctgctaaaaagcgttatacgttggtatctattccgcgtgatacaatggcgcagatggttggctccagtagttttactactgaaaagatcaatgctgcttatgaaattggcggagctcgaatgtcaatggacagcgtttctgctttgattaatgtgccgattaagtattatgccgttgtcaacatgggtggaattatgaagatgattcgctatgttggcgggatcaatattcgaccaacgcttagctttgagtatggcggctatgtctttaaaaagggtaagttaacccatatgggtggtgccggtgcactggcttactcaagaatgcgttatgatgatccgcgcggtgactatggtagacaagagcggcaaagacaagttattacaacgctaattaaaaaagctgtttcagtaagttctttaactaatttagattcaattctgacttcagtatcaagtaacgttagaactaatttgccatttagtgctttgcaacaaattgcgcttaattaccgtggttgtgctaatagttcatcaagcgattatcttcatggctataatgcgatgatcgatgatgccgcttatcaagttcaaccaacagaagaattgcagcggatttctgatttagtacgtactgagttaggcttagagaaagaaaccattaataacaatgaaacttatcaaaataagcgaaatgaagaaaatggttttagttttaagagtactaagaatcaaacctaccatatttatgattacaccgaagaaggtgataat

SEQ ID NO: 240 - protein, 367 aa, Lactobacillus acidophilus
MKDNRERENHPSGTRVQSHKYKNRHIWAWATGIILLVAVIAAVTYFASVYFKAKNAVDKTYDPATAVKTTGEFNGKKRFAVLLMGTDTGALNRTEKRGRTDTMILAVVNPAKKRYTLVSIPRDTMAQMVGSSSFTTEKINAAYEIGGARMSMDSVSALINVPIKYYAVVNMGGIMKMIRYVGGINIRPTLSFEYGGYVFKKGKLTHMGGAGALAYSRMRYDDPRGDYGRQERQRQVITTLIKKAVSVSSLTNLDSILTSVSSNVRTNLPFSALQQIALNYRGCANSSSSDYLHGYNAMIDDAAYQVQPTEELQRISDLVRTELGLEKETINNNETYQNKRNEENGFSFKSTKNQTYHIYDYTEEGDN

SEQ ID NO: 241 - DNA, 738 bp, Lactobacillus acidophilus
  misc_feature (0)...(0): ORF 1015 - capsular polysaccharide biosynthesis protein J
  CDS (1)...(738)
gtgccaattttgaataatcaatttggcaattggtgctttatgactttcttcaaagtaaaatcatttaaaaattgtactgcattacaagttcctacacctaaagtagctaaatggttaaagaaaaatcatttcaaacagaagctatttattgtttcaaacggtatcagcgaaaagtttattcaaaatccgcacaaagaaaaagttggacaccccttcactattttatgtatcggaagattttcacacgaaaaacgacaagaaactttattcaaagcaatgcagctatccaaacatacttctgaaatccgtcttatttttgctggacaaggacctttagaaaaggaatatgccaaattagctaaacagcttcctaagaaacctatcatgcgctattttgctccagcagatttgaaagaaattatgtttcagaccgatttggttgtgcactgtgctgatgtagaaatagagggaatggcttgcatggaagctttttctagtggctgtgtatctgtaattgctgatagttcgttatcttctactgttagctatgctttaagcgaaaataatcgtttctctgctggagacagtagagctcttgctcaaaaaattgattactggttcgagcatccctcagaattaataaaaatgagacaagaatatcgcagttacggtaaaacattaaatgttgcacgttcagccaaaatagccttaggtaatttagaaaatctgaccttaaag

SEQ ID NO: 242 - protein, 246 aa, Lactobacillus acidophilus
MPILNNQFGNWCFMTFFKVKSFKNCTALQVPTPKVAKWLKKNHFKQKLFIVSNGISEKFIQNPHKEKVGHPFTILCIGRFSHEKRQETLFKAMQLSKHTSEIRLIFAGQGPLEKEYAKLAKQLPKKPIMRYFAPADLKEIMFQTDLVVHCADVEIEGMACMEAFSSGCVSVIADSSLSSTVSYALSENNRFSAGDSRALAQKIDYWFEHPSELIKMRQEYRSYGKTLNVARSAKIALGNLENLTLK

SEQ ID NO: 243 - DNA, 1140 bp, Lactobacillus acidophilus
  misc_feature (0)...(0): ORF 1720 - Cap5P
  CDS (1)...(1140)
atgaacaagattaaagtaatgactgtttttggtacccgaccagaagcaatcaagatggcaccacttgttttaaaattaaagcaagatgaacgttttgaagaagttacggttgtttcagcgcagcaccgtgagatgcttgatcaggtactcgatatttttaaaattaagccagactatgactttaacatcatgcataagaaccagactttggaagaaattacttctaaagttatgattgatttggctaaagtaattaaaaaagaaaagcctgatattgttttagttcatggcgatactacaactagttttgcggcaggacttgccaccttttatgaacaaacaactctggggcacgtagaagccggtcttcgtacttggaataaatattcaccgttccctgaagagatgaatcgtcaaatgactgatgacttggcagacttatattttgctccaactgaagtgtccaaggctaacttattaaaagaaaaccatccagcagataatatttttgttacaggtaatacagctatcgatgcgcttcatgaaactgttcaaaaagattatcatcacgatgttttagatgaaattaaaccaggcaataaggttatcttggtgacaatgcatagacgagaaaatcagggcgaacctatgcgtcgcgtatttaaagtcatgcgtcaagtaatcgatagccatgatgatgtagaaattatttatccggtccatttatcaccaaaagtacaacaagtagcaaatgaagtactcggaggtgatccgcgaatccacttgattgaaccgcttgatgtggttgattttcataatttagctaagcggagctacttcattatgactgattctggtggcgttcaagaagaagcaccaagtcttggtaaaccagtacttgtgcttagagatactactgaacgtccagaaggcgttaaggctggcaccttgaaattagtgggcaccgaagtagataaggtaagagaaagtatgcttgaactgcttgaaaataaagaagcatatgacaagatggctaatgccaagaatccatatggagatggtcatgccagcgatcgaatcatgaatgcaatttattactacttcaatagagataccgcaatcaaaccgaatgattttaaa

SEQ ID NO: 244 - protein, 380 aa, Lactobacillus acidophilus
MNKIKVMTVFGTRPEAIKMAPLVLKLKQDERFEEVTVVSAQHREMLDQVLDIFKIKPDYDFNIMHKNQTLEEITSKVMIDLAKVIKKEKPDIVLVHGDTTTSFAAGLATFYEQTTLGHVEAGLRTWNKYSPFPEEMNRQMTDDLADLYFAPTEVSKANLLKENHPADNIFVTGNTAIDALHETVQKDYHHDVLDEIKPGNKVILVTMHRRENQGEPMRRVFKVMRQVIDSHDDVEIIYPVHLSPKVQQVANEVLGGDPRIHLIEPLDVVDFHNLAKRSYFIMTDSGGVQEEAPSLGKPVLVLRDTTERPEGVKAGTLKLVGTEVDKVRESMLELLENKEAYDKMANAKNPYGDGHASDRIMNAIYYYFNRDTAIKPNDFK

SEQ ID NO: 245 - DNA, 1197 bp, Lactobacillus acidophilus
  misc_feature (0)...(0): ORF 620 - Cap5P
  CDS (1)...(1197)
ttgatgcaagatagggttaaatcggttatagttaagtttagttatcggaggaaacttatgaacaagattaaagtaatgactgtttttggtacccgaccagaagcaatcaagatggcaccacttgttttaaaattaaagcaagatgaacgttttgaagaagttacggttgtttcagcgcagcaccgtgagatgcttgatcaggtactcgatatttttaaaattaagccagactatgactttaacatcatgcataaaaaccagactttggaagaaattacttctaaagtgatgattgatttggctaaagtaattaagaaagaaaagcctgatattgttttagttcatggcgatactacaactagttttgcggcaggacttgccaccttttatgaacaaacaactctggggcacgtagaagccggtcttcgtacttggaataaatattcaccgttccctgaagagatgaatcgtcaaatgactgatgacttggcagacttatattttgctccaactgaagtgtccaaggcaaatttattaaaagaaaaccatccagcagataatatttttgttacaggtaatacagctatcgatgcgcttcatgaaactgttcaaaaagattatcatcacgatgttttagatgaaattaaaccgggaaataaagttatcttggtgacaatgcatagacgagaaaatcagggcgaacctatgcgtcgcgtatttaaagtcatgcgtcaggtaatcgatagccatgatgatgtagaaattatttatccagtccatttatcaccaaaagtacaacaagtagcaaatgaggtactcggaggtgatccacgtattcacttgattgaaccgcttgatgtggttgattttcataatttagctaagcggagctacttcattatgactgattctggtggcgttcaagaagaagcaccaagtcttggtaaaccggtacttgtgcttagagatactactgaacgtccagaaggcgttaaggctggcaccttgaaattagtgggcaccgaagtagataaggtaagagaaagtatgcttgaactgcttgaaaataaagaagcatatgacaagatggctaatgccaagaatccatatggagatggtcatgccagcgatcgaatcatgaatgcaatttattactacttcaatagagataccgtaatcaaacctaaagattttgaa

SEQ ID NO: 246 - protein, 399 aa, Lactobacillus acidophilus
MMQDRVKSVIVKFSYRRKLMNKIKVMTVFGTRPEAIKMAPLVLKLKQDERFEEVTVVSAQHREMLDQVLDIFKIKPDYDFNIMHKNQTLEEITSKVMIDLAKVIKKEKPDIVLVHGDTTTSFAAGLATFYEQTTLGHVEAGLRTWNKYSPFPEEMNRQMTDDLADLYFAPTEVSKANLLKENHPADNIFVTGNTAIDALHETVQKDYHHDVLDEIKPGNKVILVTMHRRENQGEPMRRVFKVMRQVIDSHDDVEIIYPVHLSPKVQQVANEVLGGDPRIHLIEPLDVVDFHNLAKRSYFIMTDSGGVQEEAPSLGKPVLVLRDTTERPEGVKAGTLKLVGTEVDKVRESMLELLENKEAYDKMANAKNPYGDGHASDRIMNAIYYYFNRDTVIKPKDFE

SEQ ID NO: 247 - DNA, 696 bp, Lactobacillus acidophilus
  misc_feature (0)...(0): ORF 526 - CpsIVN
  CDS (1)...(696)
atgattccaaaaatcatccattacgtttgggtaggtcataatccaaagtctaagttgatccaagagtgtattgccacttggaaggaaaaattacctgattatcaatttattgagtggaatgaagataattttgatatgcacgaaaataagtacattgagcaagcttataaggcaaaaaagtgggcttttgtttcagattatattcgtgctaaagctatctatgaacaaggtgggatttatttagatacagatgtgcgtgtaattgctagtctgacgcctttgcttgataacaaggcctttattggctttgaaaacaacaattatctttcggctgcaatttttggcgcagaaaaagggcatccatttatgcaggatatccttgattattataaagatcgtaattttgaatatgatgtaaataatcaaatggcaggcgtaaatagtgtttccgttactgatatgctgattgatcggtatggtttaaagattggtaacaaggaacaggaattaaaggaaggtattcatgtttatccagatggcgttttatgtaatccgtctgttaactcactttcgattcacttatttacgggaacttggatgaacggaaaacattcatttaaacataaacttgtcactttccttaagcgtcatattaatacacctaaagaggcagggttatatgccaagtggattcga

SEQ ID NO: 248 - protein, 232 aa, Lactobacillus acidophilus
MIPKIIHYVWVGHNPKSKLIQECIATWKEKLPDYQFIEWNEDNFDMHENKYIEQAYKAKKWAFVSDYIRAKAIYEQGGIYLDTDVRVIASLTPLLDNKAFIGFENNNYLSAAIFGAEKGHPFMQDILDYYKDRNFEYDVNNQMAGVNSVSVTDMLIDRYGLKIGNKEQELKEGIHVYPDGVLCNPSVNSLSIHLFTGTWMNGKHSFKHKLVTFLKRHINTPKEAGLYAKWIR

SEQ ID NO: 249 - DNA, 1161 bp, Lactobacillus acidophilus
  misc_feature (0)...(0): ORF 444 - lipopolysaccharide biosynthesis protein
  CDS (1)...(1161)
atgaatattggtctttataccgatacatattttccccaaataagtggcgtagctacttctattaggacgctaaaagatgcgcttgaaagacaggggcataatgtatttatttttacaactacagatccaaatgtagaaaagggcactgttgagccaaatgtttttcgttttagcagtataccttttgtttcattcacagatcgtagaattgcatttagaggcttatttgaagcaactaaggtagctaaggaagtaaatttggatattgtacatacacaaactgaatttgctttaggtacaattggcaaatatgtagcccaccaattagatattcctgcaattcatacttatcacacaatgtatgaagattatttgcattatattttaaatggtcacttattgcgaccatatcatgttaaacaattcgtaaaaagctatttaaaaaatatggatggctgtattgccccaagtggacgtgtagaagatttgttaaagcgatatggcgtgcaaattccaattagggtaattcctactggagtagatttgcagggaatgaatggcgatgctgaacgtgatgtacgtcaggaattaggaatcgacaaagatgctcctgtaattttaactttaagtagaattgcagcagaaaagaaaataaatcatattcttaatgtgatgccagcaattgtagaagaatttccaaatattaaatttgtaattgccggtgatggacctgatgttaaagtgctgaaagaacaagttgaacgtttaactttagaagattatgttttatttgtcggtaacgttgatcatggagatgtaggcaattattatcgaatggccgatctttttgtttctgccagtgacactgaaacccaaggtcttacttatatagaagctttggctgcaggtacaccatgtgtagtttacgacactgattacactgaaaatatttttgataatgatgtctttggacgtacttttgttacacagaaggaaatgttgcaagaaattattgaattattgaaaaaaggacacaatagaattccacaagatcttttacaaaataaattgcagaagatttcatcggagcaatttgctacaaatgtccatgatttttataaatacgcgattgatcattatcaacctaaacatgaagaaata

SEQ ID NO: 250 - protein, 387 aa, Lactobacillus acidophilus
MNIGLYTDTYFPQISGVATSIRTLKDALERQGHNVFIFTTTDPNVEKGTVEPNVFRFSSIPFVSFTDRRIAFRGLFEATKVAKEVNLDIVHTQTEFALGTIGKYVAHQLDIPAIHTYHTMYEDYLHYILNGHLLRPYHVKQFVKSYLKNMDGCIAPSGRVEDLLKRYGVQIPIRVIPTGVDLQGMNGDAERDVRQELGIDKDAPVILTLSRIAAEKKINHILNVMPAIVEEFPNIKFVIAGDGPDVKVLKEQVERLTLEDYVLFVGNVDHGDVGNYYRMADLFVSASDTETQGLTYIEALAAGTPCVVYDTDYTENIFDNDVFGRTFVTQKEMLQEIIELLKKGHNRIPQDLLQNKLQKISSEQFATNVHDFYKYAIDHYQPKHEEI

SEQ ID NO: 251 - DNA, 468 bp, Lactobacillus acidophilus
  misc_feature (0)...(0): ORF 105 - cellulose synthase
  CDS (1)...(468)
atgaatgatgtaatgcaaataatcactcttatttcaatttggctgtcgttactgatgtctattattactttaagtggagcaattgcattttggcttaaacatagtaaggttttggttaaaatagtgccactaaagcggtatcccaaagtaacgattgttgttccagctcataatgaagaattggtaattgagaaaacagctacagcgattttaaatttaaattatcctaaggataaattggaagtattattttatgctgataattgtgaagataaaacagctgatgttttagatgaagttttaaaaaataagcagtattacaaatgtaacgcacgagttattagacgaactggttctggtggtaaagctggtgtgttgaatgatgctttgaagattgctcatggtgaatatttaggtgtttatgatgcagatgcgatgcccagaagagaatgcattatactttctagt

SEQ ID NO: 252 - protein, 156 aa, Lactobacillus acidophilus
MNDVMQIITLISIWLSLLMSIITLSGAIAFWLKHSKVLVKIVPLKRYPKVTIVVPAHNEELVIEKTATAILNLNYPKDKLEVLFYADNCEDKTADVLDEVLKNKQYYKCNARVIRRTGSGGKAGVLNDALKIAHGEYLGVYDADAMPRRECIILSS

SEQ ID NO: 253 - DNA, 1470 bp, Lactobacillus acidophilus
  misc_feature (0)...(0): ORF 507 - sucrose phosphorylase
  CDS (1)...(1470)
ttgaaccttttttataaggaaggtttaaaaatgaaattacaaaataaggcaatattgataacttatccagatagtttaggtcataatttgaaggacttggatcatgtaatggatcgctattttaataaaacgataggtggtattcatttattaccatttttcccttcaaacggtgatcgcggtttttctcctacaagatatgatgtagttgagcctaagtttggttcatgggaagatgtagaaaagttaagtcaaaagtattatttgatgtttgactttatgattaatcatctttctaaaaaatcctcatattttgaagattttgaagccaagcacgataaaagcaaatatagcgatcttttcttaagttgggataaattttggccaaagggcagaccaactaaagaagatatagatttaatttataaacgaaaagataaggccccatatcaaaatattaaatttgaagatggtactcatgaaaagatgtggaatactttcggcccagatcaaatggatttggatgttagaaccaagacaacacaagattttataaagcataatttacaaaatctttctaaacatggtgctagtttgattcgtttagatgcatttgcttatgcaattaaaaagttagatacaaatgacttctttgtagaaccggaaatttggaatttactcgaaaaggtaaatgattatcttaaagatactccaactactattctgcctgaaattcatgagcattatacgatgccatttaaggtggcagaacatggatactttatttatgattttgctttaccaatggtattgttgtattcactttatagcggtaatagtactcaacttgctgcttggctaaagaaatgtccgatgaagcaatttactactttagatacccacgatggattaggcgtagttgacgcaaaggatattcttacggacgatcaaattagctacacaacaaacgaactttataaaattggtgctaacgtcaagaagaaatattctagtgctgaatatcataatttggatatttatcaaattaatactacttattattctgcattgggtaatgatgataaaaaatattttattgcacggttattacaaatctttgcccctggtattccacaaatttattatgttggattgttagcaggagaaaatgatattcaattattagagaagacaaaagaaggacgcgatattaatcgccactattatgatttggatgagattgcggaacaagttcaaagacctgtagtaaaatctttgattaagttattggaatttcgtaattctgtacctgcatttgatttggaaggttcaatcaaagttgaaactccaagtgaacatgaaattattgtcactagatcaaataaggcaggaacagaagtagctagtacgtacgtagactttaagaacttagactatcaagttaaatacaatgatcaggtctttaatttt

SEQ ID NO: 254 - protein, 490 aa, Lactobacillus acidophilus
MNLFYKEGLKMKLQNKAILITYPDSLGHNLKDLDHVMDRYFNKTIGGIHLLPFFPSNGDRGFSPTRYDVVEPKFGSWEDVEKLSQKYYLMFDFMINHLSKKSSYFEDFEAKHDKSKYSDLFLSWDKFWPKGRPTKEDIDLIYKRKDKAPYQNIKFEDGTHEKMWNTFGPDQMDLDVRTKTTQDFIKHNLQNLSKHGASLIRLDAFAYAIKKLDTNDFFVEPEIWNLLEKVNDYLKDTPTTILPEIHEHYTMPFKVAEHGYFIYDFALPMVLLYSLYSGNSTQLAAWLKKCPMKQFTTLDTHDGLGVVDAKDILTDDQISYTTNELYKIGANVKKKYSSAEYHNLDIYQINTTYYSALGNDDKKYFIARLLQIFAPGIPQIYYVGLLAGENDIQLLEKTKEGRDINRHYYDLDEIAEQVQRPVVKSLIKLLEFRNSVPAFDLEGSIKVETPSEHEIIVTRSNKAGTEVASTYVDFKNLDYQVKYNDQVFNF

SEQ ID NO: 255 - DNA, 1644 bp, Lactobacillus acidophilus
  misc_feature (0)...(0): ORF 1616 - Polysaccharide transporter
  CDS (1)...(1644)
atggaagaagaaaataacttaaatagcaaagatacacaaaatacctttctaaaaggttctgcgtggatgacttttggctcaattgcctcaagaattctgggagctttatatattattccgtggtatgcctggatggggcaatatggtaatatcgccaatgccttaactgcacgaagttataatatttatactatttttatcttaatttcgactgcaggtattcctggtgcgatcgctaaacaggtagcaaagtataatgctttaaatgaatatggaattgggcgtaggttattccataaaggattaattttgatggccattctaggggtggtttcagctgcaattatgtattttgcttcgccgcttcttgcttcaaatggtagtcaaagtgatccgaggcaaattgcggttatgcggagcttgtcatatgcaatcttgattatccctattttaagtattatgcgtggatattttcagggttatgcggatatgatgcctagtgcaatgtcgcagtttgtagaacaatttgcccgtgtcgtctggatgcttttgactgcttttgtaattatgcaagtccagcatgggtcatatgttcatgcagttattcaatcaaatttggctgctgcagttggagcagcatttgggattggattattagtctggtttttgttttcacgtaggaaacaattggattatctagtagctaattccaataatcggttacgtgtgtccactacagaattatttgcggaaattattgaacaggcaattccctttatcattattgactcagggattacattgttctcgttggttgatcaatatactttccatccaatgattgctgggttggttcatgcaagttcagatgcgatcgaagattggtatgcactatttggcttaaatgctaataaattaattatgattatcgtatctttagctagtgcaatggcagtaacagcaattccacttttgtcagctgctcatacaagaggtgactacaagagtatttctcgtcagattgctaatacgatggatttattcttgttcgtaatgattccagcggcatttggaatggctgccattagtcgaccgatttatacagttttttatggaccagatcaattaggtagtaatgttttatacttgtctgcttttactgcaatcagtttagggttgtttactgtattaatggcaattttgcagggactttcagaaaatggcctggcaattaagtatttagttctaggtttaattttaaaaggaattctacagtatccgatgatcttcttgtttaagatatatggtccacttgtagcaactaatttaggattattggtaatagttctgttgtcgctcaaacacttagaagttcagtataactttaacttaaatcgaactagtcggagattagtaggtattacagccttttcaattggaatgtttataattgttaaattggttgaaatgggattaggtaaattcttaagtcctgatcgaagaatttcagctttaattttagtaattgtagcagtaagtattggcataatattctatggctttgctgcattgaagacagatttagctcaaaagattatgggaagtaaaatcgaaagtattttggttaggttacgcatccatgat

SEQ ID NO: 256 - protein, 548 aa, Lactobacillus acidophilus
MEEENNLNSKDTQNTFLKGSAWMTFGSIASRILGALYIIPWYAWMGQYGNIANALTARSYNIYTIFILISTAGIPGAIAKQVAKYNALNEYGIGRRLFHKGLILMAILGVVSAAIMYFASPLLASNGSQSDPRQIAVMRSLSYAILIIPILSIMRGYFQGYADMMPSAMSQFVEQFARVVWMLLTAFVIMQVQHGSYVHAVIQSNLAAAVGAAFGIGLLVWFLFSRRKQLDYLVANSNNRLRVSTTELFAEIIEQAIPFIIIDSGITLFSLVDQYTFHPMIAGLVHASSDAIEDWYALFGLNANKLIMIIVSLASAMAVTAIPLLSAAHTRGDYKSISRQIANTMDLFLFVMIPAAFGMAAISRPIYTVFYGPDQLGSNVLYLSAFTAISLGLFTVLMAILQGLSENGLAIKYLVLGLILKGILQYPMIFLFKIYGPLVATNLGLLVIVLLSLKHLEVQYNFNLNRTSRRLVGITAFSIGMFIIVKLVEMGLGKFLSPDRRISALILVIVAVSIGIIFYGFAALKTDLAQKIMGSKIESILVRLRIHD

SEQ ID NO: 257 - DNA, 1089 bp, Lactobacillus acidophilus
  misc_feature (0)...(0): ORF 520 - LPS biosynthesis protein
  CDS (1)...(1089)
atgaaggttttgcatgtaaatgctggtcttgaaaatggtggcgggttatcgcatattgtaaatttgcttactgaggctaaaagagaaaataaagattttgatttattaactttggctgatggtccagtggctgctgcagcaagagaacatggaattaatacttatgtacttggagcaaagagtcgctacaatttggcaagtttaaaaaagttgatcaaatttattaatgatggacattatgacatagtgcatacacatggtgcccgagctaatctttttctttctttaattcataagagaatctcagctgtatggtgcgttactgtgcactctaacccatatcttgattttgaaggacgcggctttttaggcaaagttttcactaagtttaatttacgtgcattaaaaaaagcggactgtatatttgcagtcactaagcgttttgccaatctgttagttaatcaaacacaactagataaaaataaagtacatgtgatttataatgggatctttttccacaatgatagtgaaatccctgctaaatatgagcatacttactttaatgtaattaacgtagctcgtacagaaaaagtgaaagggcaagaattgttacttaaagcagttaaaaagctcaacgatcaacatatccgtttacatattgcaggagacggcagtcaacttgaaccacttaaagctcttactcgccagctaaatatggcaccccaagtaacttttcatggctttatgactcatcatcagttaagtggactttataaaagaattgatctggctgttttaacatcatattcagaaagttttccccttgttttattagaagcaaccgataatttaattcctatcttatctactgatgttggtgacatccataagatgattccaggacctaaatatggttttattgctaaaactggtgatattgattcaattgccaagcagcttgaattagctgtcaataagactacaaagcagctacgtgaaatggcctatacagaaaaacgctatgctgaagaacacttttctgtgaagaatcaactagcagatattgaaaaagtttatagtactttaatc

SEQ ID NO: 258 - protein, 363 aa, Lactobacillus acidophilus
MKVLHVNAGLENGGGLSHIVNLLTEAKRENKDFDLLTLADGPVAAAAREHGINTYVLGAKSRYNLASLKKLIKFINDGHYDIVHTHGARANLFLSLIHKRISAVWCVTVHSNPYLDFEGRGFLGKVFTKFNLRALKKADCIFAVTKRFANLLVNQTQLDKNKVHVIYNGIFFHNDSEIPAKYEHTYFNVINVARTEKVKGQELLLKAVKKLNDQHIRLHIAGDGSQLEPLKALTRQLNMAPQVTFHGFMTHHQLSGLYKRIDLAVLTSYSESFPLVLLEATDNLIPILSTDVGDIHKMIPGPKYGFIAKTGDIDSIAKQLELAVNKTTKQLREMAYTEKRYAEEHFSVKNQLADIEKVYSTLI

SEQ ID NO: 259 - DNA, 1668 bp, Lactobacillus acidophilus
  misc_feature (0)...(0): ORF 1872 - oligo-1,6-glucosidase
  CDS (1)...(1668)
gtggaggaaaaaattatgtcacattggtacgatcatgcaattatttatcaaatttatcctaagtcttttcaagatagcaatgacgatggtattggcgatcttaatggtattcgtaaaagaattccctatttacaaaatttaggagttaatgcagtttggcttaatcctgtttttgtttcgccacaagtggataacggttatgatgtctcaaattattttgcgattgattctcacatgggaacgatggaagatatggagaatttaattaaagatctgcataaagctggaattcatatcattatggattttgtcttaaatcatacttcagatcaacatccatggttccaagatgctattaagaatccggatagtttatatcgtgattactacatttttgctggtcatgataataaacaacctaataattggggatctttctttggaggaagcgtctgggaacctgatccggcaggtactggtcagtcatattttcacttatttgataaacggatgccagatcttaactggaaaaaccctgaagttcgacatgctatgcttgaaatagctgaattttggttaaagaagggaatagacggcttaagacttgatgcatttattcatattggtaaggcagacttaagacaaaattatccagctatggatgataaaccggttattgcagagccgttttttgctaatttgccacaagtgcaagaatggatgagaccattttgtgaacaaattaaagaagattatccagatgcacttttacttggtgaagcagctagtgctagcgttaacttagcagttgattatacgaataaacgtaatcatttaatggattgcgtgattacatttcgttattttacagaagatgattccaaaatcgataagagttattccgcacaatatcagcctaaggagcttgatttaacagcttttaaacaaaatcaggtggtttggcaacaaacgttagctgatatatcacaacccacgctttattggaataatcacgatatggcaagacttgctactagaattgcgaagacttcaactcaagcaaagagcttagcaatgttgatgtatctgcaacgcggtattccgattatttattatggtgaagaattagggcttaagaatttacactttactagtgttgatcaatttgaagatcaaactgttgctccatggataaaagaggcacaaaaagctggaataagtagagatgccgcatttgctatggttagcgatacccataaattaccggctcgtggtccaatgccatggaacgatacagaaaataatggttttactagtgctaaaccttggctcaatggaattagtcaagatgatgtaacagttgcaaatgaagtcaactctgataacagcatgtttactttttataaaaatatgctgaatctgaaaaaagaaaaactattccaagacggaacttactatatgatctcaactggtaaggacagttacgtttatcaacgtgatttgggcaatgagagtgcgattgtagctgtttcgttaagtaataaaaagatttcaatcgatcttccggaagagtatattaaagaactattaaaggctggggaatatcaattaactaatggaaaattaactttaatgccttacgcgggtgttgttttgaaaaaggagaat

SEQ ID NO: 260 - protein, 556 aa, Lactobacillus acidophilus
MEEKIMSHWYDHAIIYQIYPKSFQDSNDDGIGDLNGIRKRIPYLQNLGVNAVWLNPVFVSPQVDNGYDVSNYFAIDSHMGTMEDMENLIKDLHKAGIHIIMDFVLNHTSDQHPWFQDAIKNPDSLYRDYYIFAGHDNKQPNNWGSFFGGSVWEPDPAGTGQSYFHLFDKRMPDLNWKNPEVRHAMLEIAEFWLKKGIDGLRLDAFIHIGKADLRQNYPAMDDKPVIAEPFFANLPQVQEWMRPFCEQIKEDYPDALLLGEAASASVNLAVDYTNKRNHLMDCVITFRYFTEDDSKIDKSYSAQYQPKELDLTAFKQNQVVWQQTLADISQPTLYWNNHDMARLATRIAKTSTQAKSLAMLMYLQRGIPIIYYGEELGLKNLHFTSVDQFEDQTVAPWIKEAQKAGISRDAAFAMVSDTHKLPARGPMPWNDTENNGFTSAKPWLNGISQDDVTVANEVNSDNSMFTFYKNMLNLKKEKLFQDGTYYMISTGKDSYVYQRDLGNESAIVAVSLSNKKISIDLPEEYIKELLKAGEYQLTNGKLTLMPYAGVVLKKEN

SEQ ID NO: 261 - DNA, 2277 bp, Lactobacillus acidophilus
  misc_feature (0)...(0): ORF 1365 - Alpha-glucosidase
  CDS (1)...(2277)
atgaaatatttgaatggaaattggctagtgagagatggctttgcaatcgattatggtcaaagtatttacgatagtgaaattaaagatgataaattaactttatgggtgccttttaaagtgattaccaatccggggatgacgctggatgatgggatgcttaccttagagattacctcaccaagagaaaatattattcgcactaagattattaattttaaaggcgccattgataacggtcctaaatttgatttaaacgtagattccaaatttaagccgaatatttttgaagatagtgaaaaatttactattgaatcaggtaatacacgtcttgaaattcaaaaaggtgatcaaatcttatttacgtatttctataaaaatgaaatgcgtgctgaaataccggcacgttcggttgctagaatttttgatcctaaaggtcacacccatatttcaaattcatttgtacttgaaccagacgaaaagatttatgggttaggagaaagattttccaattttgttaaaaatggtcaagaagttgaaatgtggaatgcagatggcggtacagaaacaatccaatcctacaagaatattccattgtacttatctaacagaaaatatggtatatttgttaattcaattgccaaggtctcctatgaagttgcttctcaacaagttgaccgcgtagaattctctgttccaggtcaagaacttgattatatatttattggtggaatggataacaaggaagtattagatcactacactgccttaacaggtcgtccaccacttcttccagcatggagctttggtttatggttgactacatcatttactactaaatatgatgaagagacagttatgagctttattaatggtatgcttgatcgtcatattccattatctgtctttcactttgactgttgctggatgaagccaacacaatggtgtgactttgtatgggatccagatatctttccagatccagaaggtcttttgaagaagatccatgataaaggtattaaagtttgtgtctggattaatccgtatattgcccaaaaatctcgtttatttgaagaagggatgaagaatggttacttcattaagaagagtaatggggatgtatggcaatgggataagtggcaagctggtatggccattgttgactttactaaccctgacgcagttaagtggtatcaaggctatttgaaagaactgcttcatcaaggagtcgatgtctttaagacggactttggtgaccgaattccaagtgaaggcgttaaattctttgatggttcagatcctaagaaaatgcataattactacacacttttgtataacaagatcgttactgatgcaattagtgaagttaaaggaaaaaaagaggctcttgtctttgctagaagtgcaactgtaggtagtcaatgttacccagtccattggggtggtgactcatcttcgaactactcatcaatggcggaaactcttagaagcggcttgtcctttagtatgagtggctttggctattggtcgcatgatatttcagggtttgaagcaagtgctacaccagacttatataaacgctggagtcaatttggtttactaagttctcattcaagatatcatggttcaactacttataaagttccatggttatatggtgatgaagctgtagaagtatcaaagaaatttaccaatttaaaattacggttattgccgtatcttcttgcaatgtctaacgaagctcataaacatggtacgccaattcttcgtccaatgattttagaattccctgatgatccgggatgcgaagaccttgatatgcaatatatgcttggtggtagtctgttggttgctccaattttcaatgaccaaggagaagcttgtttttatgccccacaaggtcaaggtaaatggattagtttactaactaatgaaagttatgaaggtggacgctggtacaagcaaaagtttaatgaaaagactttgccattacttgtaaaacctaattcaattattgtgactggcgaacatgatgatcagacgatgtatgattacactaagcacccaagtattcatttatttgaaatgcaagatggcaaagtatcgacaataattactgataattatggtaaaaaagtagcgacggtaacttctgaaaagtcggctgataagattgtagtaactacagaaaatattgaaaaatttgatttaataattcatcgtagtgatcaatacgccgtaattatgaaagataatcaacaaaaagtagaagttgatcta

SEQ ID NO: 262 - protein, 759 aa, Lactobacillus acidophilus
MKYLNGNWLVRDGFAIDYGQSIYDSEIKDDKLTLWVPFKVITNPGMTLDDGMLTLEITSPRENIIRTKIINFKGAIDNGPKFDLNVDSKFKPNIFEDSEKFTIESGNTRLEIQKGDQILFTYFYKNEMRAEIPARSVARIFDPKGHTHISNSFVLEPDEKIYGLGERFSNFVKNGQEVEMWNADGGTETIQSYKNIPLYLSNRKYGIFVNSIAKVSYEVASQQVDRVEFSVPGQELDYIFIGGMDNKEVLDHYTALTGRPPLLPAWSFGLWLTTSFTTKYDEETVMSFINGMLDRHIPLSVFHFDCCWMKPTQWCDFVWDPDIFPDPEGLLKKIHDKGIKVCVWINPYIAQKSRLFEEGMKNGYFIKKSNGDVWQWDKWQAGMAIVDFTNPDAVKWYQGYLKELLHQGVDVFKTDFGDRIPSEGVKFFDGSDPKKMHNYYTLLYNKIVTDAISEVKGKKEALVFARSATVGSQCYPVHWGGDSSSNYSSMAETLRSGLSFSMSGFGYWSHDISGFEASATPDLYKRWSQFGLLSSHSRYHGSTTYKVPWLYGDEAVEVSKKFTNLKLRLLPYLLAMSNEAHKHGTPILRPMILEFPDDPGCEDLDMQYMLGGSLLVAPIFNDQGEACFYAPQGQGKWISLLTNESYEGGRWYKQKFNEKTLPLLVKPNSIIVTGEHDDQTMYDYTKHPSIHLFEMQDGKVSTIITDNYGKKVATVTSEKSADKIVVTTENIEKFDLIIHRSDQYAVIMKDNQQKVEVDL

SEQ ID NO: 263 - DNA, 2301 bp, Lactobacillus acidophilus
  misc_feature (0)...(0): ORF 1812 - ALPHA-GLUCOSIDASE II
  CDS (1)...(2301)
atggctaacaaacttaaaaatttcatccaagatgggcaaaaagttaccttaaattatgaagatggggaacttgaattaagggttctaacgcctgaaattgtgcgtgtatttgaaaatcgtggcaatgctagcaattcatatgctatcgctggtgataaggaaataaaaactaattttcgtattgaagaaaaagatgatcatgcagagttatcaacagaaaagttgttcgtaaaaatttacgatgacaaaaagattgatgtttatgatgaaaaggatcatccattgatcattgattatcgcggtgagcgtacgccgattgatcgtcaaatggacgaggaacataaaaaatcggcagaatcagaaggtcatgaggttgctggtagtaaaaaagaagataaaaactattatgaaatcgttaaaaaactagctagtgatgaacaattttacggcttaggtgataagactggctttttaaataagcgtcattatgcctataataactggaatactgacgatccagcacctcaagttgaaagcttcccaagtctttataagtcggttccgatcttgctcggcttaaaagatggtcatccctatgggattttctttgacaatacttatcgtaaccacattgacttaggtaaagaaagtaacgattattactactactccgcagttgatggcaacattgattactacatcattggtggtgattcacttaaagaaattatcaccaactacacttacttgactggtcgtgtaccaatgccgcagaaatggaccttgggctatcaacagtctcgctggggctacagtgtcagccaaaagcaagttgagaaaattgcggaaaacttgcgcaagtatgatttgccgtgtgacgttttgcatcttgatatcgattatatgcgtgggtatcgtgtatttacctggagaaaagatacttatgaatcaccagataaattcatcaagaagatgcgtaaattgggctttagaatcatcacgattattgacccaggcgtaaagaaagatgatgactataagatttacaaggaaggtcttgaaaaaggctacttcgttaaggctccagatggtacggtttatgtaaatgaagtttggccaggcgatgctgtcttcccagactttggtcgcaaagaagtacgtaaatggtgggctagaaattgtaagtacttagttgatcttggcgtttcaggtatctgggacgatatgaatgaacctgcatcatttagaggtgaaattccacaagatattgtctttcataacgaagagcaagcttcaactcataagaagatgcacaatgtctatggtcataatatggctaaagcaacttatgaaggtttgaagaaatattcaggcaagcgtccctttgtcattacgcgtgcggcatatgcaggaacgcaaaagttttccacagtttggactggtgataaccaaagtttatggacgcatgtccaaatgatgattccgcaattatgtaacttgggaatgagtggatttagttttgccggtactgatattggtggtttcggtgctgatacgacgccagaattattgactcgttggatcgaaggtgcattatttagtccgttgtacagaaaccatgcggctctaggtactcgctcacaagagccatgggtatttggtgaaccaactttgtcaatttaccgtaaatacttgaaacttcgctaccgctttattccatatctttacgatgaattttatcgtgaaactaggacaggtttgccaattatgcggccacttgtcttgaattatgaaaatgatccacaggtgtataacttgaatgatgagtatatggttggcgaggatattttggcagccccagttgttcaagagggtcaaactaagcgtgccgtatatttgccaaaaggaaaatggattgatttttggaatggtgttgaatattctggaaagaccacgattttggttgatgcaccaattggtaaattgccattgttcattaagaagaatactatcctgccatggggcaaggaagtaagtcacatttccgatgagccagacgagagtatgacctttagagtatttggtaaaaagggtaagtacattcactatcaagataacggaactgacttcaagtaccaaaagggcgaatacaacttgtacaaggttaaggtaagtaaggatggtagcgtaaaggttaagcttgaaaagcatggcttcggtcctgtatatcgtagaattacggttcaattgcctaataagaaggttgaatttaagtacaagaatggtgaatacgttagaaaa

SEQ ID NO: 264 - protein, 767 aa, Lactobacillus acidophilus
MANKLKNFIQDGQKVTLNYEDGELELRVLTPEIVRVFENRGNASNSYAIAGDKEIKTNFRIEEKDDHAELSTEKLFVKIYDDKKIDVYDEKDHPLIIDYRGERTPIDRQMDEEHKKSAESEGHEVAGSKKEDKNYYEIVKKLASDEQFYGLGDKTGFLNKRHYAYNNWNTDDPAPQVESFPSLYKSVPILLGLKDGHPYGIFFDNTYRNHIDLGKESNDYYYYSAVDGNIDYYIIGGDSLKEIITNYTYLTGRVPMPQKWTLGYQQSRWGYSVSQKQVEKIAENLRKYDLPCDVLHLDIDYMRGYRVFTWRKDTYESPDKFIKKMRKLGFRIITIIDPGVKKDDDYKIYKEGLEKGYFVKAPDGTVYVNEVWPGDAVFPDFGRKEVRKWWARNCKYLVDLGVSGIWDDMNEPASFRGEIPQDIVFHNEEQASTHKKMHNVYGHNMAKATYEGLKKYSGKRPFVITRAAYAGTQKFSTVWTGDNQSLWTHVQMMIPQLCNLGMSGFSFAGTDIGGFGADTTPELLTRWIEGALFSPLYRNHAALGTRSQEPWVFGEPTLSIYRKYLKLRYRFIPYLYDEFYRETRTGLPIMRPLVLNYENDPQVYNLNDEYMVGEDILAAPVVQEGQTKRAVYLPKGKWIDFWNGVEYSGKTTILVDAPIGKLPLFIKKNTILPWGKEVSHISDEPDESMTFRVFGKKGKYIHYQDNGTDFKYQKGEYNLYKVKVSKDGSVKVKLEKHGFGPVYRRITVQLPNKKVEFKYKNGEYVRK

SEQ ID NO: 265 - DNA, 1632 bp, Lactobacillus acidophilus
  misc_feature (0)...(0): ORF 264 - glucan 1,6-alpha-glucosidase
  CDS (1)...(1632)
gtgagggtaaaaattatggcttcatggtggaaaaatgctgttgtttatcaggtttatcctaagtctttccaagacagtaacggtgatggaataggagatttgcaagggattatttcaagattagactatctagaaaaattaggaattgatgctatttggctttcaccagtttatcaatctcctggtgttgataatggatatgatatttctgattatgaagcgattgatccacagtatggcacaatggcagatatggacgagttaattagcaaggctaaagaacatcatatcaagatagtgatggacttagtggttaatcatacttctgatcaacataagtggtttgtagaggccaaaaaaggaaaggataatcaatatcgtgattattatatttggcgtgatccagttgatgaacatgagcctaatgacttaaaatctgctttttcaggttctgcttggaaatatgatgaaagaagtggacaatattatctacatttctttgctgatcaacagcctgatttgaattggcaaaataccgagttacgtcagaaaatctacaacatgatgaacttttggcttgataagggaattggcggttttcgtatggatgtaattgaattaatcgggaaggatccagacaagaacattcgtgaaaatgggccaatgctacatccatatttacaagaaatgaataaagctacttttggtaaacgtgatgtgatgacagtaggtgaaacttggaatgcaacaccaaagattgcggaagaatattctgatcctgatcgtcatgaattgtcaatggtctttcaatttgaaaatcaatctttagatcaacaacctggtaaagaaaagtgggatttaaaacctcttgatttaggagaattgaaaaaagtattggttaagtggcaaacaaaaatcgattttgatcatgcttggaatagtttgttttgggagaatcacgacattccgcgagttatttcgcgctggggtaatgatcaagaataccgtgtccaatgcgccaaaatgtttgcaattattttacatatgatgcacggtacaccttatatttttaatggtgaagaaattgggatgactaattgtcctgttaaaaatattgatgaggttgaagatattgaaagtattaatatgtataacgaacgtttagcggaaggttatgatgaagaagagttgattcatgcaatcaatgtaaaaggtcgtgataatgcacgtcgaccaatgcaatggaatgatgaaaaaaatgctggcttttctgaagttgatccatggctaagtgtaaatcctaattataaggacattaatgttgaaaatgcgttagcagatccaaattcgattttttatacttatcaaaaattgattaaattacgtcatgaaaatccgatcgtagttgatggtgatttttcattagtgtctaatacacaagatgcagtgcttgcttattatcgcattttgaatgataaaaaatggttggtagtagctaacttatctaatgaggagcagaattttgtatctaatgatcaaattgaaacgatcctcagcaactatccagaaagaaataatgtacaaaatatcacccttaaaccatatgaggctttcataagcaaagtaattgaa

SEQ ID NO: 266 - protein, 544 aa, Lactobacillus acidophilus
MRVKIMASWWKNAVVYQVYPKSFQDSNGDGIGDLQGIISRLDYLEKLGIDAIWLSPVYQSPGVDNGYDISDYEAIDPQYGTMADMDELISKAKEHHIKIVMDLVVNHTSDQHKWFVEAKKGKDNQYRDYYIWRDPVDEHEPNDLKSAFSGSAWKYDERSGQYYLHFFADQQPDLNWQNTELRQKIYNMMNFWLDKGIGGFRMDVIELIGKDPDKNIRENGPMLHPYLQEMNKATFGKRDVMTVGETWNATPKIAEEYSDPDRHELSMVFQFENQSLDQQPGKEKWDLKPLDLGELKKVLVKWQTKIDFDHAWNSLFWENHDIPRVISRWGNDQEYRVQCAKMFAIILHMMHGTPYIFNGEEIGMTNCPVKNIDEVEDIESINMYNERLAEGYDEEELIHAINVKGRDNARRPMQWNDEKNAGFSEVDPWLSVNPNYKDINVENALADPNSIFYTYQKLIKLRHENPIVVDGDFSLVSNTQDAVLAYYRILNDKKWLVVANLSNEEQNFVSNDQIETILSNYPERNNVQNITLKPYEAFISKVIE

SEQ ID NO: 267 - DNA, 3012 bp, Lactobacillus acidophilus
  misc_feature (0)...(0): ORF 143 - ALPHA-GLUCOSIDASE II
  CDS (1)...(3012)
atgacacaaaatacgcaaatagaaagacaccaattaggtcagcttatcggtgccaataaacgcgatcattattatgaactccactattccaccggagaagttgctcgtctttatattttagctgaaggaatattccgttattttcttgatccggctaaggaattcgacgaaaatcactcctcttttgttgacctaacacaatttgataatagttattttgaaaaatccaagcctaaagctacaagcgattctttgattattcaatctggtaattaccaattaatcttttggcaaaaaccagcagtaatgaatatttttgatgagactttacaccgtaaccgcgttgttcagcttagtccgcttgaactagatcaaaatcaaactaccgaaattttaaagcaacataaaaatgaattttatttcggtggtgggatgcaaaatggctacttcagccacaagggtcaaatcattgatattaaacgtgacaaaattactggtaaaggtggcgtattaacacaggttccatttttctgggcaaattccggctttggtgaattaagaaatactactgcccctggtcaatatgattttggcaaaaaagatgaagatgccgtaatcttacgtcatgactctcaaatatttgatacattctatcttttgggtaactctcctacagatattttggaaaaatattatgttctaaccggtaagccattaatgccacctaaatatgcattgggcttgggacatgtcggcaactttttgactaccctatggcaacctggtgaagctaaagaacgcaacgccactatgtttgaagatggtaactattacaccagaactactaatccggaaaatgctaatggtaaggcatcattaaatggtgaggaagaatatcaattctccgctcgtgcaatgattgatcgttatcaaaagcaacatttcaaactaagctggattgtacccaactacaatatccaagatgttgatgccgagcaaatgaccagttttagcgattatgctgcgtcaagagaagttaatgctggcgtttggagcggtgacgaaacaccaaagactgctcccgacactacttttattcaaactgatactagtgatcctaaaacacttaaaaatgactcactgatcttacgtgataatttaaagcgtaaacgtccacttattttttcaaatacaggtattgccggtagtcaaaacagaataatgttggcctttggcgatattggcggtaattgggaaaatattccaactcaagttgccggctttttaggtgcaagtttatctggtcaaccattagttggtagtgcagttgacggaactgttggtggaggtaatgctcaaatcagtatccgtgattttgaatggaaggcattcacgcctattcttttcaatcttgacgatcaaggcaattttagtaaaacgccatttgcttataacagcaagatgaccaagattaaccgcgcatatctaaagctccgtgaacaacttcaaacttacatgtatacgctcatctatcgtgcgcaagttggtgaacctatcatgagaccattatttttagaatttcctcatgagcaaatcaattacacatcacaagttggtcacgaattcatgcttggtcctaacttgcttatttcaccaattgtaaacggccgagaagatggtaatgggaattcaagaaaagacaatctttacttaccaaatcaccgtaccatgtggatcgatttattcgatggtaaaaagttcttaggtggccgcgtttataacaaacagtcttatccatcttggcatttacctgtctttgtacgtggcggatcaatctttgacttgggtgatcgtaattacgttctttacccacaaggacgtagcaaaatggttacttacgatgataatggctacaatgattattctagaaatcatgtagcaacgcagattactagtgatcttgaagcaagcaagttaactattaccattgatccaactcaaggtgatttcagtactttccaaacggaaaacaccactaatctaaatattatgtgtgatggttatccagacggtttaaccgttaagattaatgatcaagttgtcaatatgcaagaatatggcactgttgatacattcgcacatgcaaaagaaggtttcttctttaataccaactacagctggatgcctgaatttgatcaatatcaagaaaagaagcaaacagctttacaaattaaattggctaaacgggatattactgattcaaagattgaaatcactatccgtaacttcagatatggtaatgaaactttggttcacgcaattactgattcattgcttcactcaccaaagcagccaatggtcgatcctgataaaattagttcacattcattgactgttgtttggccacaattaaccgataaggtccaaattgaagttaacggcattttgcatgatggcattgatggtagctcatttaccttccacgaattagtgccaaatactcgctacactttacgcttgagatatgttgctggtaataaagtttctgaatggtcagaaccatttggtgcaattaccaaaccggatccaatgaattacgctatcagtaatatccatgtcaccagtagtttaaccagtcaaaaagatcatccaattgaatatttgactgatctaaagcttgccagcgaatgggaaactattaacggcgtaagtgaagacaaaccacttgaattaaacttcaagttcgaccatttggaacacttaagtagaatggttttggtacctagaaagattgatcatcaaggcgatccagttgaggtcagcgttgaaacctcaatggatggtactaactttaagccatacgacgaacgacttacttggaagtctgacagcaagaataaagttgtcggcttgagggatgtagaagctaaggcaatcagattaaaggtttataagtcatctggcccatttgtggcagctaaggaagttatcttctttagagagaagaaagat

SEQ ID NO: 268 - protein, 1004 aa, Lactobacillus acidophilus
MTQNTQIERHQLGQLIGANKRDHYYELHYSTGEVARLYILAEGIFRYFLDPAKEFDENHSSFVDLTQFDNSYFEKSKPKATSDSLIIQSGNYQLIFWQKPAVMNIFDETLHRNRVVQLSPLELDQNQTTEILKQHKNEFYFGGGMQNGYFSHKGQIIDIKRDKITGKGGVLTQVPFFWANSGFGELRNTTAPGQYDFGKKDEDAVILRHDSQIFDTFYLLGNSPTDILEKYYVLTGKPLMPPKYALGLGHVGNFLTTLWQPGEAKERNATMFEDGNYYTRTTNPENANGKASLNGEEEYQFSARAMIDRYQKQHFKLSWIVPNYNIQDVDAEQMTSFSDYAASREVNAGVWSGDETPKTAPDTTFIQTDTSDPKTLKNDSLILRDNLKRKRPLIFSNTGIAGSQNRIMLAFGDIGGNWENIPTQVAGFLGASLSGQPLVGSAVDGTVGGGNAQISIRDFEWKAFTPILFNLDDQGNFSKTPFAYNSKMTKINRAYLKLREQLQTYMYTLIYRAQVGEPIMRPLFLEFPHEQINYTSQVGHEFMLGPNLLISPIVNGREDGNGNSRKDNLYLPNHRTMWIDLFDGKKFLGGRVYNKQSYPSWHLPVFVRGGSIFDLGDRNYVLYPQGRSKMVTYDDNGYNDYSRNHVATQITSDLEASKLTITIDPTQGDFSTFQTENTTNLNIMCDGYPDGLTVKINDQVVNMQEYGTVDTFAHAKEGFFFNTNYSWMPEFDQYQEKKQTALQIKLAKRDITDSKIEITIRNFRYGNETLVHAITDSLLHSPKQPMVDPDKISSHSLTVVWPQLTDKVQIEVNGILHDGIDGSSFTFHELVPNTRYTLRLRYVAGNKVSEWSEPFGAITKPDPMNYAISNIHVTSSLTSQKDHPIEYLTDLKLASEWETINGVSEDKPLELNFKFDHLEHLSRMVLVPRKIDHQGDPVEVSVETSMDGTNFKPYDERLTWKSDSKNKVVGLRDVEAKAIRLKVYKSSGPFVAAKEVIFFREKKD

SEQ ID NO: 269 - DNA, 1710 bp, Lactobacillus acidophilus
  misc_feature (0)...(0): ORF 1014 - Dextran glucosidase
  CDS (1)...(1710)
ttgttgattttgcaagaagacagaagattaaattgtaaggagaaaagtatgattaatttaggcaaaaaaataatttatcaaatttatcctaaatctttctatgattcaaatggcgatggggtaggagatcttcaaggaatcattcaaaagattgattatattaagaagttaaatgtagacatgatctggtttaatccattttttgtttcaccgcaaaatgataatggttatgatattgctgattattacaacattgatcctcgctttggtacaatggctgattttgagaaattggtaaagaagctgaaagaaatcggtgtgggtgtaatgctagatatggtgctcaatcactgctcaactgaaaatatttggtttaaaaaagcacttgctggcaatgaaaagtatcgtaaatttttctacttgagaaaaggaaaaaacggaggtttacctaataattggcaaagtaaattcggtggtactgcttggtcaaaatttggtgataccgattactactaccttcacttgtatgatccaactcaagcagatcttgattggcataatcctgaagttcgtaaagaattatttaaagtggttaacttttggcgtagtaaaggtgtccatggcttccgctttgatgtaattaatgttacgggtaaagcggaaaaactagttgattcaacagatcctgtagaagaaaagagtttgtacactgatactccaattgttcataaatacttaaaagagcttaatgctgcaacttttggtcaagaccctgaatcaattactgtgggagaaatgtcatcaacgacgattgccaactcaattgaatattcaaaaccaagtgaacatgaattatcaatggttttcactttccatcatttgaaagttgactatcaggatggtgaaaagtggtctaagatgccatttgattttatgaaattaaaggaattattcactgaatggcaagaaaaaatggatcaaggtgatggctggaacgcattattctgggacaatcatgatcagccttgggcattaactagatttggtgatactggtaagtatcgtggaaagtcagctgaaatgcttgccacagcaactcatcttatgcggggaacaccatatatttatatgggtgaagaaattggtatgattgatcctgattattcttcaatggatgattacgtagatgttgaggccaagaatgcttttaaggctttaactaaaaaaggtttgagtgataaagaagcttttgaaatagttaaatcaaaagctcgtgacaattcacgtgtaccaatgcattggaatagtgaaaaatatgcaggttttagtgaacataagccgtggctcataccaactgatcaagaaaaaattaatgttgaagaggaattagcacatggtgaaatttttaattactatcaaaagttaattaagctgcgtagaagcgaagatttaatctctgatggtcatattaagatgttcttgaaagatgatccgcaggtttttgcttatgaacgctacttaaaagatagtgataaaaagttattggtatttactaacttctatggtaaagaacatagtgttaaattacccgaagaatatcaaaacaaagaataccaagttttaattaacaattatgatactaaagatagccaattaaccgatgaaattatattgaagccatatgaagcattagctattaaaattaaacaa

SEQ ID NO: 270 - protein, 570 aa, Lactobacillus acidophilus
MLILQEDRRLNCKEKSMINLGKKIIYQIYPKSFYDSNGDGVGDLQGIIQKIDYIKKLNVDMIWFNPFFVSPQNDNGYDIADYYNIDPRFGTMADFEKLVKKLKEIGVGVMLDMVLNHCSTENIWFKKALAGNEKYRKFFYLRKGKNGGLPNNWQSKFGGTAWSKFGDTDYYYLHLYDPTQADLDWHNPEVRKELFKVVNFWRSKGVHGFRFDVINVTGKAEKLVDSTDPVEEKSLYTDTPIVHKYLKELNAATFGQDPESITVGEMSSTTIANSIEYSKPSEHELSMVFTFHHLKVDYQDGEKWSKMPFDFMKLKELFTEWQEKMDQGDGWNALFWDNHDQPWALTRFGDTGKYRGKSAEMLATATHLMRGTPYIYMGEEIGMIDPDYSSMDDYVDVEAKNAFKALTKKGLSDKEAFEIVKSKARDNSRVPMHWNSEKYAGFSEHKPWLIPTDQEKINVEEELAHGEIFNYYQKLIKLRRSEDLISDGHIKMFLKDDPQVFAYERYLKDSDKKLLVFTNFYGKEHSVKLPEEYQNKEYQVLINNYDTKDSQLTDEIILKPYEALAIKIKQ

SEQ ID NO: 271 - DNA, 1914 bp, Lactobacillus acidophilus
  misc_feature (0)...(0): ORF 680 - 1,4-alpha-glucan branching enzyme
  CDS (1)...(1914)
atggtaacgatagtggaggttaaacaacatattaaaaaatttgcagctggcaatgagctatatcttcaagaagtattagggtgtcattatgaaaatgatatctatacttttagagtatgggcaccaaatgcgcaaaaagtttggctagttggcgattttaatgattgggataaatcattagaaatgagtcagactttagatggagtttgggaaataaagaccagcttacccaaagaaggacagctatataagtttctagttaaacaagctgatggtcgtgaggtaatgaaaattgatcctatggcgttcgaattagagcctagaccaggcagtgcagctgtgattgttaagttacctaataaaaagtggcttgacggtgcatggatgggacgaaataaaagatcgaatcattttgctcgaccaattaatatttatgaagtacatgctagttcatggaaaagacatacagatgggtctctgtatactttgaaggatttacaaaaggaattaattccgtatgttaaagaacaaggatttaattatatcgaatttttgcctttaacagcacatcctttagatgcttcatggggatatcaaacaattggttattatgctttggagcgtacttatggtacaccacgagagctgcaagattttgttgaagcatgtcacaaagaaaacatcggtgttttggctgattgggtaccaggacacttttgtattaatgatgatgccttggcttattatgatggcacaccatgttatgaatttagcgaaaaatggagagccgaaaataaaggctggggagctctaaattttgatttaggcaaaccggaagtgcaatcatttttactttctagtgccctattttggctagaattttatcatttggatggcttgagagttgatgctgtttctaacatgatttatcgcgattatgaccgcagtgacggtgaatggaaaacagataaatttggtggaaatcgtaatttagaggggatagaattcctacaaaaactaaatcgaaccattaaaggcaaacatccagaatgtttaatgattgccgaggaaagttctgctcaagtaaagataactggtcgaatagaagatggtgggttaggttttgattttaaatggaatatgggttggatgaacgatattttacgtttttatgagatggacccattatttagaaaatttaattttaatctagctactttttcattcatgtatcgaatgagtgaaaactttattttacctttatcacatgacgaggttgttcatggtaagcgaagcctaatgaataaaatgtttggcgaccgtgataagcaatttgctcaattacgtaatttacttacattgcaaatgacctatcctggtaaaaagcttttatttatgggaagtgaatttggacaatatcttgaatggcgatataacgatggcttagattgggcagaattaaaggatgaactgaatgctaaaatgaagcattttgatcaagatttaaatagtttttatttaaatgagccggctttgtggcaattagaacaaagagaagattctgttcaaattattgacgcagataataaagatgagtcagtcttgtcatttattcgtcaaggtaaaactagacatgactttttaatagttattttgaattttacacctgttgatcgaaaaaaaattacaattggtgttccatatgctggtaaatattgtgaagtctttaatagtgccagaaaagaatatggtggcagttggaaccaagaaaagcagaatttgaaaactcaaaataattcatttaagaattttaattatcaagtgcaattggatataccgggttttagtgctgtgattttaaaacctgtagatgttcatataaaaagaagaattaatagaaaaacaaaaactaag

SEQ ID NO: 272 - protein, 638 aa, Lactobacillus acidophilus
MVTIVEVKQHIKKFAAGNELYLQEVLGCHYENDIYTFRVWAPNAQKVWLVGDFNDWDKSLEMSQTLDGVWEIKTSLPKEGQLYKFLVKQADGREVMKIDPMAFELEPRPGSAAVIVKLPNKKWLDGAWMGRNKRSNHFARPINIYEVHASSWKRHTDGSLYTLKDLQKELIPYVKEQGFNYIEFLPLTAHPLDASWGYQTIGYYALERTYGTPRELQDFVEACHKENIGVLADWVPGHFCINDDALAYYDGTPCYEFSEKWRAENKGWGALNFDLGKPEVQSFLLSSALFWLEFYHLDGLRVDAVSNMIYRDYDRSDGEWKTDKFGGNRNLEGIEFLQKLNRTIKGKHPECLMIAEESSAQVKITGRIEDGGLGFDFKWNMGWMNDILRFYEMDPLFRKFNFNLATFSFMYRMSENFILPLSHDEVVHGKRSLMNKMFGDRDKQFAQLRNLLTLQMTYPGKKLLFMGSEFGQYLEWRYNDGLDWAELKDELNAKMKHFDQDLNSFYLNEPALWQLEQREDSVQIIDADNKDESVLSFIRQGKTRHDFLIVILNFTPVDRKKITIGVPYAGKYCEVFNSARKEYGGSWNQEKQNLKTQNNSFKNFNYQVQLDIPGFSAVILKPVDVHIKRRINRKTKTK

SEQ ID NO: 273 - DNA, 1719 bp, Lactobacillus acidophilus
  misc_feature (0)...(0): ORF 1871 - neopullulanase
  CDS (1)...(1719)
atgcaattagccgctttaagacacagaacagaaagtgaagatagttttgtagttgatccaaaacatgttcgtgttcgttttcacactgcaaaaaatgatgttgaaaaagtaattgttcattactgtgataattatttaccattaaaatttgcagaaactactgaaatggaaaagatcggtgagggtcaagttgaagactattggggtattacacttgatgcaccatatcatcgtttaaagtacacttttgaagttattggtaaggacggtacaagtgtagtttatggtgaccgtgcgattagcgatgatattaaagacgcaatcaatgaagatggatcatattttaaaattccatattgtcatgaaattgatatggtcaaaacaccagactgggttaagaataccgtttggtatcagatattccctgaacgttatgctaatggggataaatcaaacgatcctaagaatattaagccatggaatccaactgatcatcctggtagagaggattattatggcggtgatttgcaaggtgtcttagatcatttagattatttacaaaagctaggcgttaatggtttatacttttgtccaatttttaaagcgagctctaatcataaatatgacacgattgattatttacaagtagatccggaatttggtgataaagatttatttgctaaagtggttaacgaagcacatgcacgtggtatgaagattatgctcgatgccgtatttaatcacttaggtgatcaatcaatgcaatggcaagatgtagtgcaaaatggatctaagtcacgttttgcagattggttccatattaatgagtatccagttgaaccatatcgtaatccattaaaaggcgaaaagaatccgcaatatgatacttttgcctttgaagaacatatgccaaagttgaatactgctaatcctgaggttcaagatttcttgttagaaattgctacatactgggtgaagtattttgatatcgatgcatggcgtcttgatgtggcaaatgaagttgatcatcacttctggaagaagttccataaagcagtcactgatattaagccagacttttacattgtaggtgaagtttggcattcggctcgtccatggcttaatggcgatgaatttacaggtgtaatgaactatccgtatactttgcaaattgaagaccactttttcaagcataagttaactgctgatcaaatgactacacgcttgactgatcaacttatgaaatatcgtgattctactaatgaagcaatgatgaatatgctcgattcacatgatactgccagaattttgacagttgcaaaaggtgatcaagacttggcgcttcaagcattaacttttgaattcatgcaaaaaggtagtccatgtatttattacggaactgaaatggggatggctggagataatgatccagattgtcgtaagccaatggattggtcaaaagaagatggacctgtatggcaaagggttcataagctaattaaattccgtttagctcatgataaaacgctcagtgaaggtaaaatcaagttaagcgtaacagaaaataggctaattgaagttattagagagggcaaagaaagtattcatgcttactttaatacaactaaaaatgatgtaaaacttgatggtaaagctgaattaagtcaagattttgaaaaaggaatactcgctccaaaaggctttgtaatcatggttgat

SEQ ID NO: 274 - protein, 573 aa, Lactobacillus acidophilus
MQLAALRHRTESEDSFVVDPKHVRVRFHTAKNDVEKVIVHYCDNYLPLKFAETTEMEKIGEGQVEDYWGITLDAPYHRLKYTFEVIGKDGTSVVYGDRAISDDIKDAINEDGSYFKIPYCHEIDMVKTPDWVKNTVWYQIFPERYANGDKSNDPKNIKPWNPTDHPGREDYYGGDLQGVLDHLDYLQKLGVNGLYFCPIFKASSNHKYDTIDYLQVDPEFGDKDLFAKVVNEAHARGMKIMLDAVFNHLGDQSMQWQDVVQNGSKSRFADWFHINEYPVEPYRNPLKGEKNPQYDTFAFEEHMPKLNTANPEVQDFLLEIATYWVKYFDIDAWRLDVANEVDHHFWKKFHKAVTDIKPDFYIVGEVWHSARPWLNGDEFTGVMNYPYTLQIEDHFFKHKLTADQMTTRLTDQLMKYRDSTNEAMMNMLDSHDTARILTVAKGDQDLALQALTFEFMQKGSPCIYYGTEMGMAGDNDPDCRKPMDWSKEDGPVWQRVHKLIKFRLAHDKTLSEGKIKLSVTENRLIEVIREGKESIHAYFNTTKNDVKLDGKAELSQDFEKGILAPKGFVIMVD

SEQ ID NO: 275 - DNA, 3555 bp, Lactobacillus acidophilus
  misc_feature (0)...(0): ORF 1710 - pullulanase
  CDS (1)...(3555)
atgaaaaaatataataaatggggaacaaaaggtgtttttatttgtgcttcagcacttttaagtgtttggctaggagcaacatggactgatggcaatgtgcaagcagcagaaacaccagatgctggaaatcaagcatctactgaagtgagtcagagagttatcactgaaaatgagaaaaagactgttgtacagccagctaaggatactcaaactgatgagaaggatacagataatactcaattagctagtgcaactccatcggaagaaactactcaagttgaagaagctaagcaacaagcattaaaagatacgactaaagttgtagtccattatcagggtgatggttctaagtgggttccgtatatttggggtaaaaaaccaaatggcaatggtaatcaatacaagtgggatggtaaagatgactatggctactattccaacattacagttgatggtaatgaacaagaaatgggtgttttaattaagggcaaagattcttgggataaagatggtcaaggaaacgacagaatcgtaaaagttggtgataatggtaaagctgaagtttggtataaagaaggtagcgatgaagcacaagatgtaaagccaacatatgattcggctaaagttaatattcattatcagggtaatgatgacgtaacatctattagttattggactaatacagatcctcaaaataagaaaattatcgatttatcgaaatctgacgttcaagaaaaagagggatcgttcgatttatcaaatactaaattcaatagtatctttgtagcacctattggtactgatacagaagtaagagaatttactccactacctggtaaaagtgctacagatatttacctagtgactaaagatccaactgtttattatactaagagttttgctttagctactcaaagcttaacttcagcctcaatggattcaggcaagactgttaatattcaaactggtaaggaaatgacagctgctgaagcaaaaaagaacctttcaataaaggataattctattgtgaatgtagttgcagttaatccagatcaagatggtaagagtaagcaattcacaattaccacagcacaagatttgagtattttagataataatcaaattggtatttatggtaactacaagtctattgatattggtagttatgtaagatccaaagactttgatacgaaatattactataatggtgatgatttaggtgctacttacactgaaaagcaaagtcaaattaagttatgggcaccaaccgctaagaaagttgttttaaatctttatgattcactaaacaacgatgcttcagctacaaagacttttgtaatgaacagaggagacaaaggtgtgtggtcagttattcttccaggtgattacaagaactgggcatacgattatagtttatccttcggtaacggcacaactacccaaaccaacgatccatattctaaagccgtgactattaacggtgatcgttctgttattgaagacgttgatgcaattaaaccaaatgatttctcaagattgccacaattttctgcaccaactaatgcaattatctatgaaaccagcattagagacttcactagtgacaagaattctggaatcaaagataaaggcaagtatttgggcatgattgaatctggcgtaactccagatggtcaaattacgggcttggattacttgaagtcattaggcgtaacccatgtacaaattatgccaatgtttgactttgcaagtattaatgaaagtaaggcagatgatagctataattggggttatgatcctaagaattataatgttcctgagggtagctattcaagcaatgcagctgatcctactaccagaattatggaaatgaaggaaatgatcaatggccttcataaagccggcattagagtagtgatggacgtagtttataaccacgtttacaatacggacgagcaatcattgaataagactgttccaggatattatttccaatatgattctgaaggtcatacaactaacggtactggttgtggtaatgatatggctagtgaacgcttgatggcacgtaagtatattgttgattctgttaaatactgggctaaaaactacaatatcgatggctttagattcgatttaatgggtattctagatgttgatacgatgaatgaagttagatctgaacttaataagattgatccgagcatcttagtttatggtgaaggctgggatatgagaaagaccgatcatgatattggtgcaggtcagtataatgccgacaaggttgataaatcaattggcttcttctcagatgatattcgtaacgcaatcaaaggtgccgaatttggtggagtaactccaggtttggttgaaggaaacggtaaagaagagaactataaggaagatgctaagaagtttatagatggtttcttaggcggtcagaattatggcaaggatgctaagcacccatatcaagcaccagaacaaacaattaattatgtagcttgccatgataaccgtacattgtacgatatgttgaagactttaatgcctgatgaatctgaagctaatattatcaagcgtgataaattagctacatcaatgatgatgctatctcaaggtattccgtttatccatgcgggacaagaaagtcttggtactaaagatggtaatgaaaatagttacaatgcttccgtagaagtaaatgagattaactggggccgggtaaaagaaaacaaagatatggttgactactttaagaagttagtaaaccttcgtaagagtcaatcagtatttagacaaaatgattacagtcaaatcaataagaatgtaaaagttcttaatgacgggcaaaatggtgtatttgcatttgaatataatactaatggtaagaaactatatgtagcatttaatgttaatgataaagatgctaaattggaaaacgttgatttatcggtagctactaagttactggatagtgatggtaatactcagattggcaaagaaagtgttttgaaaccattgagtacattagttgctgaagtttcaactaaagaagcgaagccagatgatagttcaagcataatcaatccgccagtaaacaccaatattggagataataatacagatactttattgtctactgttgatattgttcttactcataatgcttatatttatgaaaatgatggtattacaacggttaaagctaatgatggtaagaacgtgacattaaaggtaggacaaacaattcatgcacttaataaggcacaaatagtaattcttaataataaagaattctatcaaattggcgataaccaatatgttaaagtaaacaatactttgaattggaatatattgaagcataattcatttgtatactctaagagtggtaaagccttaaagaaaaatcacaagcggattttgctcaagaaaggtcacaaagttttgcttttggataatgcttgtttgactaagattcatggtaagcaattctacagaattggaaataataaatatgtaaaagcagtgaatgttgttattgaagtaaaagct

SEQ ID NO: 276 - protein, 1185 aa, Lactobacillus acidophilus
MKKYNKWGTKGVFICASALLSVWLGATWTDGNVQAAETPDAGNQASTEVSQRVITENEKKTVVQPAKDTQTDEKDTDNTQLASATPSEETTQVEEAKQQALKDTTKVVVHYQGDGSKWVPYIWGKKPNGNGNQYKWDGKDDYGYYSNITVDGNEQEMGVLIKGKDSWDKDGQGNDRIVKVGDNGKAEVWYKEGSDEAQDVKPTYDSAKVNIHYQGNDDVTSISYWTNTDPQNKKIIDLSKSDVQEKEGSFDLSNTKFNSIFVAPIGTDTEVREFTPLPGKSATDIYLVTKDPTVYYTKSFALATQSLTSASMDSGKTVNIQTGKEMTAAEAKKNLSIKDNSIVNVVAVNPDQDGKSKQFTITTAQDLSILDNNQIGIYGNYKSIDIGSYVRSKDFDTKYYYNGDDLGATYTEKQSQIKLWAPTAKKVVLNLYDSLNNDASATKTFVMNRGDKGVWSVILPGDYKNWAYDYSLSFGNGTTTQTNDPYSKAVTINGDRSVIEDVDAIKPNDFSRLPQFSAPTNAIIYETSIRDFTSDKNSGIKDKGKYLGMIESGVTPDGQITGLDYLKSLGVTHVQIMPMFDFASINESKADDSYNWGYDPKNYNVPEGSYSSNAADPTTRIMEMKEMINGLHKAGIRVVMDVVYNHVYNTDEQSLNKTVPGYYFQYDSEGHTTNGTGCGNDMASERLMARKYIVDSVKYWAKNYNIDGFRFDLMGILDVDTMNEVRSELNKIDPSILVYGEGWDMRKTDHDIGAGQYNADKVDKSIGFFSDDIRNAIKGAEFGGVTPGLVEGNGKEENYKEDAKKFIDGFLGGQNYGKDAKHPYQAPEQTINYVACHDNRTLYDMLKTLMPDESEANIIKRDKLATSMMMLSQGIPFIHAGQESLGTKDGNENSYNASVEVNEINWGRVKENKDMVDYFKKLVNLRKSQSVFRQNDYSQINKNVKVLNDGQNGVFAFEYNTNGKKLYVAFNVNDKDAKLENVDLSVATKLLDSDGNTQIGKESVLKPLSTLVAEVSTKEAKPDDSSSIINPPVNTNIGDNNTDTLLSTVDIVLTHNAYIYENDGITTVKANDGKNVTLKVGQTIHALNKAQIVILNNKEFYQIGDNQYVKVNNTLNWNILKHNSFVYSKSGKALKKNHKRILLKKGHKVLLLDNACLTKIHGKQFYRIGNNKYVKAVNVVIEVKA

SEQ ID NO: 277 - DNA, 1767 bp, Lactobacillus acidophilus
  misc_feature (0)...(0): ORF 686 - amylopullulanase
  CDS (1)...(1767)
atgaaaataacttatgattcttggcaagagcagtataaaaacccttttggtgctgttaaagctggtaatacagttaaatggtcaatcaaaatagatcaagtaatacaaggagctgtcttgtggttgactaaaagtcgagaaacaccagtggcttatccgatgaactatgatgaacagactaaaatgtataccacacaggtaaaaattggtacatctggtttatacaattactactttgctttgcaacaaaataatcaaatagtttatatagatcaaggactttttggtaaaggacacgtaactaaaagtgatcatgatttaagacagtttcaattaacttgttatgatattgcaactccacgaatcgattggtatcaaaagggcattgtttatcaaatttttccggatcgctttgctaatggaaatccatatgaagaagttataggtaaaaaaaggaatagttttatctatgctactaaagaagatattccatattatataaaaaatagtgaaggtgctatagtgcggtgggacttttttggcggtaatttaactggaattagaaaaaagatcccttatttaaaacaactaggtgttacagtcctttatcttaatccaatttttttagctaaaagtaatcatcgctatgatacaacagattttatgaaaatcgatccaatgttgggtgatgaaaaagatttagctgacttaattagggaattacatgagaataatatgcatctaatattagatggagtatttaatcatgtaggttttgatagcatttattttcaaggagcgattactgacaaaaatagtaattatcgttcttggttcaactttcaagactatccaaataaatatcagtcttggtggggtgtaaagtctttaccgactgttaataaagataattctgaatatcaaaatcttgtttatggcgatcatggtgtattagctaagtggaaagttgatggttggcgacttgatgtagctgatgagttaccgatggatttcttgcgtaatattcgtaaccgtttgataaaggaaaattgtccaattttgattggggaagtttgggaagatgcttcaaataaatttgtaaatggtgaatatcgaacttatacagctggtgataatttaatgggggttatgaattatccgatacgcaattttattatcagtttgttatcagctcaagatagtactatagagatagaagcaatgaatgacctggctttactgattgaaaattatccaactgactttttgcataattgtttaaataatatcggtacccatgatacggtaagaattaaaaccgttttgaataaaaatgataatttagtcatgatggcttttggcttattatttatgatgcccggagttccatgtatttattatggcgatgaggctggcttaattggtaaagaagatccagataatcgacgttactttctatggggacatgaagataaaaagctaatagattgtgttagcagttggaccaaaatacgcaagcaaaatccagtattggtaaatggcaaaatcggttttgtacatttgtcggctggggttaatagtatagttagatataatgatcaagagatgattatgtattgcgttaattgtactaacgaagatgtgataccgttgcgtgaaaagtattcattttattggttgccgagcataattattgataaaatcaaggatactttggaccaaattcaacttaaagcacaaacagattttattaagaaaatatcgcta

SEQ ID NO: 278 - protein, 589 aa, Lactobacillus acidophilus
MKITYDSWQEQYKNPFGAVKAGNTVKWSIKIDQVIQGAVLWLTKSRETPVAYPMNYDEQTKMYTTQVKIGTSGLYNYYFALQQNNQIVYIDQGLFGKGHVTKSDHDLRQFQLTCYDIATPRIDWYQKGIVYQIFPDRFANGNPYEEVIGKKRNSFIYATKEDIPYYIKNSEGAIVRWDFFGGNLTGIRKKIPYLKQLGVTVLYLNPIFLAKSNHRYDTTDFMKIDPMLGDEKDLADLIRELHENNMHLILDGVFNHVGFDSIYFQGAITDKNSNYRSWFNFQDYPNKYQSWWGVKSLPTVNKDNSEYQNLVYGDHGVLAKWKVDGWRLDVADELPMDFLRNIRNRLIKENCPILIGEVWEDASNKFVNGEYRTYTAGDNLMGVMNYPIRNFIISLLSAQDSTIEIEAMNDLALLIENYPTDFLHNCLNNIGTHDTVRIKTVLNKNDNLVMMAFGLLFMMPGVPCIYYGDEAGLIGKEDPDNRRYFLWGHEDKKLIDCVSSWTKIRKQNPVLVNGKIGFVHLSAGVNSIVRYNDQEMIMYCVNCTNEDVIPLREKYSFYWLPSIIIDKIKDTLDQIQLKAQTDFIKKISL

SEQ ID NO: 279 - DNA, 1305 bp, Lactobacillus acidophilus
  misc_feature (0)...(0): ORF 36 - cyclomaltodextrin transport membrane protein
  CDS (1)...(1305)
gtgaaaaagtttttaataggtatcgtatttggaattgctttgtttttgactcaaaaaacaaatattacatatgcggcaaatttaagtgataattttacgcaaattttgattgataatgaccagaataatttgcttaataatagcgaaattgctcacattagtgttaaatttaatgatcaaaaaaataaatttacaaaagatagcactatgtttatcttattaaattcgaataaaaaggatgttcatgtacaagcattaaatgaagtgaaaaaattaataattaaagacgatactggtgaggcttatcaagttggcaaatatattgttaaaaataatcaagtacaagtaatttttgataaaaatattgaaaagtttgaaaatatatccggtcaaattgattttgatatacaaataagtaatgaaactacttctaatcaatttattcaaatagaagcaggcgaaattaatgaaaaaatttatgtttcatctcgtccacaagttaataaaaatgtcgtaaccgaaattagtggcaaatataactcagataaaaataaaattgcttgggaaataaagataaactctgagaataaaagcgagctacaaatttttaatactattgaaaatcaaaatattgatcaagatacgttaaaaataaaaatagacggtaatttaattaaactcaataaaaataatattgaatttaataaaggattaaagctgaagttggtaggtaaagatattgttattacatatattactagtgcaagtgaagttagttctgtacttaatatagtccgtgtaattgaagataatgaaaatcaaaatgttactagtgcaaaagtacaagtaaatgatatcgttaacattgatggaaaatttaatcagacatctacgaataagaaacaaagagagaaaaaaatttctaaatttttttctaatttagctaaattaattattgataaaaagcaagaaaaaactgatcaaaataatgatgaaaaaagtcaatttgaattagctcaatctactgctttagctaatgccaagtcaacaaaacatgacatggtcgtttcaagtaaaacaccgtcattagatgatacttttgagcataatattgatgataaagaagttaaagaaactataaatgagagtattcctaatactaaaaaggctcattcaaaaaagcattccgcaaataaaagtaacttacctaaaacgggagaagataatatagaattatttttcagtatagtaggaactatttttttgagtatctcagctatatttttttataaaaaatccagaaaa

SEQ ID NO: 280 - protein, 435 aa, Lactobacillus acidophilus
MKKFLIGIVFGIALFLTQKTNITYAANLSDNFTQILIDNDQNNLLNNSEIAHISVKFNDQKNKFTKDSTMFILLNSNKKDVHVQALNEVKKLIIKDDTGEAYQVGKYIVKNNQVQVIFDKNIEKFENISGQIDFDIQISNETTSNQFIQIEAGEINEKIYVSSRPQVNKNVVTEISGKYNSDKNKIAWEIKINSENKSELQIFNTIENQNIDQDTLKIKIDGNLIKLNKNNIEFNKGLKLKLVGKDIVITYITSASEVSSVLNIVRVIEDNENQNVTSAKVQVNDIVNIDGKFNQTSTNKKQREKKISKFFSNLAKLIIDKKQEKTDQNNDEKSQFELAQSTALANAKSTKHDMVVSSKTPSLDDTFEHNIDDKEVKETINESIPNTKKAHSKKHSANKSNLPKTGEDNIELFFSIVGTIFLSISAIFFYKKSRK

SEQ ID NO: 281 - DNA, 1146 bp, Lactobacillus acidophilus
  misc_feature (0)...(0): ORF 530
  CDS (1)...(1146)
gtgaaaaaatatttgcaaattatggctttagcagggatagccattactttaactggttgtgggagattgaaagactctagtttagcgaataatgcaactactacttcaacaactaagaaaaagagttatcaaacaactaataccggtaatagtggctattctgttttattgaaaaatggacgctatgtagttagtccaattgctggtttaacagcaaccgataatgataattcagttgatacaagagaattagaacgtggcttgattcaaatttctaagaatcaattctcaactaatcagtatgttttccaagaaggacaacaactggatacttcaactgtaactgattggttaaccagaaaatcaaagactaatcctcaaggattaaatccagtcaataatggtaagactggaactgatactagaaatccaatttatttagaagaaattgttgagcaagattatttaactggttcaggttctaagtatcaattaggtggtatgagtcttggcttagcaatgaattccgttgactattaccaaaaaaagcgtgatggtgcagaatttcaaactgatatttccaaagctacccagcgtgctcaaggtgagaaaatagctaatgaaattgtggctcgtttgcgtaagcgtaagagcttgaagaatattccaattaccattggattattctctaaaacaggaaaagattcattagttggcggaacttactttgcttacgggacagcggccgctaatagtagtaaaataactaaatggaaatccatgtcggaaaaaatgcaagttttaccgacaactggtaatgaaaaagcaattaatagcgacgacgcatctcatttcaatgattttaagacggcaattcaaaattacttccctaatattagtggagtaacggcaactttgcgttatgataatggcaagctggctcaagaaaatatttcaattacgacccagttttatggttatgagcaaattcaaagttttactcgtttaaccttatcaacagcgaagaaatatttgccgaacaatattccaattgaaatcaagattggatcagttgatgacgtacaagcattaattgcaaaagaaaccggcgatagtgattatcaagtccatgtttatggcggcgaa

SEQ ID NO: 282 - protein, 382 aa, Lactobacillus acidophilus
MKKYLQIMALAGIAITLTGCGRLKDSSLANNATTTSTTKKKSYQTTNTGNSGYSVLLKNGRYVVSPIAGLTATDNDNSVDTRELERGLIQISKNQFSTNQYVFQEGQQLDTSTVTDWLTRKSKTNPQGLNPVNNGKTGTDTRNPIYLEEIVEQDYLTGSGSKYQLGGMSLGLAMNSVDYYQKKRDGAEFQTDISKATQRAQGEKIANEIVARLRKRKSLKNIPITIGLFSKTGKDSLVGGTYFAYGTAAANSSKITKWKSMSEKMQVLPTTGNEKAINSDDASHFNDFKTAIQNYFPNISGVTATLRYDNGKLAQENISITTQFYGYEQIQSFTRLTLSTAKKYLPNNIPIEIKIGSVDDVQALIAKETGDSDYQVHVYGGE

SEQ ID NO: 283 - DNA, 519 bp, Lactobacillus acidophilus
  misc_feature (0)...(0): ORF 701 - cell surface protein
  CDS (1)...(519)
atgattttttggctagaactcaatcaagataaagattatggtcaaatccctgttattggtgaagacggacaaattcaatttatcatacaaggcaatctcgataatccaaatcatactttgtatctagataacactaataaagaagaaattggacgtttgttttctgatggagcaggactcattgcttcttttactatcgacgtcgtaaatcattctctagtaggtgtaaaaaaattaaacacacctaataccaatatattttatataaccaaattaaaatatattgttacaggtagtattaaacatggtacctatacctttagatccggaattaaaaatgtagccagtgtaaaaactatgatgggtgatcatggtgtggttttggtatgtgatattagtaagcccgaagatatcccatttattcttttaagctctgtattatttactcagtggcatgtaactcctttaaaattgccaatttttccacctattggcaacaagtttggagtaaatcctaat

SEQ ID NO: 284 - protein, 173 aa, Lactobacillus acidophilus
MIFWLELNQDKDYGQIPVIGEDGQIQFIIQGNLDNPNHTLYLDNTNKEEIGRLFSDGAGLIASFTIDVVNHSLVGVKKLNTPNTNIFYITKLKYIVTGSIKHGTYTFRSGIKNVASVKTMMGDHGVVLVCDISKPEDIPFILLSSVLFTQWHVTPLKLPIFPPIGNKFGVNPN

SEQ ID NO: 285 - DNA, 1242 bp, Lactobacillus acidophilus
  misc_feature (0)...(0): ORF 833 - cell division protein
  CDS (1)...(1242)
gtggtgacttttttgttttataatgaaaaaagtattatttcacataaaggggcaacgctcgtgcgtcgaaaattaagatatcttaattaccgaattttaatcccatacttaattttagtagttgtaggaataattttggtatattcagcaagttcagacattttattagttaatggatttaagccagatgtttatggaattcgtcaagcaatctatgctgctgtagcattttttggatttggtattcctttttttgcattaaggctaaaggttattaaaaatccaaaatttgtagctggttttttaataatctgtattttaatgctgctatggttggtctttttaagatttgctcatggtagtgcagcagccgttaatggggctgttggttggattaacttgggtttcattaatcttcagccgttagaagttactaaattggctttagtaatttatttagcttatgttttggatcgaagagacggaaaattagtaaggggaaaaattaaagataatctatctcatcctgctatgctagctggtttcttaatgtgtttagttattgtagagcctgactttggtggtaccgcaattttattcatgattacgttagtaatgttttccgtatctggtgtaccagttaggttagcactaacttggctactcggaatcatactattagttggggcagtttttattttagtagttctttggaatcctaaatttttgcaggatagttatcaatttcaacgattgatgtcatttttacatccctttcaacttgaaagaaaaggtggagcccaattagttaattcttactatgcaatccataatggaggattgtttggtgtaggattagggaacagtatgcaaaaacgaggatatttgccagaaccatatactgattttattttatctattacagccgaagaaattggcgttatcttcacgattgtactggttggtctattattttatttaatgtggcaaattatggaagtaggtattaatgccgtctcacaatttgatgcattaatttgctttggcgtgacaacaattatttttactgaagcattgtttaatatcggtgctgtattaggtctattaccaattactggtgttacgctgccatttatttcgtatggtggttcttctatgatcgttttaactgctgcaattgggttagtgctgaatgtatctgctaatgaaaaaatgttaaaagaaaaggatgaaacaattgca

SEQ ID NO: 286 - protein, 414 aa, Lactobacillus acidophilus
MVTFLFYNEKSIISHKGATLVRRKLRYLNYRILIPYLILVVVGIILVYSASSDILLVNGFKPDVYGIRQAIYAAVAFFGFGIPFFALRLKVIKNPKFVAGFLIICILMLLWLVFLRFAHGSAAAVNGAVGWINLGFINLQPLEVTKLALVIYLAYVLDRRDGKLVRGKIKDNLSHPAMLAGFLMCLVIVEPDFGGTAILFMITLVMFSVSGVPVRLALTWLLGIILLVGAVFILVVLWNPKFLQDSYQFQRLMSFLHPFQLERKGGAQLVNSYYAIHNGGLFGVGLGNSMQKRGYLPEPYTDFILSITAEEIGVIFTIVLVGLLFYLMWQIMEVGINAVSQFDALICFGVTTIIFTEALFNIGAVLGLLPITGVTLPFISYGGSSMIVLTAAIGLVLNVSANEKMLKEKDETIA

SEQ ID NO: 287 - DNA, 453 bp, Lactobacillus acidophilus
  misc_feature (0)...(0): ORF 919
  CDS (1)...(453)
atggaaagttggttatttcttgcattgattttggttgtagcattattaggcaagaacatgtctttgattattgctacagcagtagttatgctttttaaattattaccatttactggaaagtggctacctactattcaggctaaaggaataaattggggagtaactattatttctgtggctattttaattccgattgctactggtcaaataggttttaaagatttaattagaacattcaaaacaccagctgggtggatagctattttggctggtatagcagttgctgttttatcaagatatggtgttaatcaacttgctgcagttcctcaagtaaccgttgctttagtacttggaacgattattggggttgtagcatttaaaggcgtagctgctgggcctgtaattgcgagtggaatgacatatttagtagttactttgtttaacctgcatttt

SEQ ID NO: 288 - protein, 151 aa, Lactobacillus acidophilus
MESWLFLALILVVALLGKNMSLIIATAVVMLFKLLPFTGKWLPTIQAKGINWGVTIISVAILIPIATGQIGFKDLIRTFKTPAGWIAILAGIAVAVLSRYGVNQLAAVPQVTVALVLGTIIGVVAFKGVAAGPVIASGMTYLVVTLFNLHF

SEQ ID NO: 289 - DNA, 1353 bp, Lactobacillus acidophilus
  misc_feature (0)...(0): ORF 927 - membrane protein
  CDS (1)...(1353)
ttgattttaccaatggaaaatgaacaggcacgtcgattatcacaaaaacatcatatgaagatcctttgggaggatttttttaaaagtgacgatgatacgatagctcaagatgctactttggttgaaaagacatctattgttggacgaataggaattatgttgcttagttgcggtactggtgcatggagagtccgtgactcaatggatacagttgctagaacgcttggtataacttgttcaacagacattggtctggtttcgattgaatatacttgctttgacgttgataatgaatcctattcacaaactttgtctttaccatctaccggtgtaaatatgactaaattaaatgaattagaaaaattaattcgtcaatttgaaaaagaacgtggaaattggacaataggtcaaatccataaaaaattgcgtgagattgaaaatcaaaagtctgcatatccgtctataatagcagtattaagcgcaggactggcatgtgctggatttatctttttattgggtggaggcctacccaaggttatctgtgcattttttggagcgggtgtcggtaactatgttcgctcaattatgggaaaacgaaaaattacattagttgccaagattgcagtagcagtagcaatagcatgggctgtttattttatttgttttcatattggcatgatattatttcacttggattatcatcatgcatatggctatatcggtgctatgctgtttgttattccaggttttccatttattacatctggtctagatatgtctaaattagatatgagatcgggacttgagcgtttaacgtatgcaattttagtcattattattgctactatggctggctgggctgtagcaacaattttgaatttacatccaggttcaatgctaagattgaaaattgatcccggtatgttaacctttttgaggttaattgcaagcttttgtggagtatttggattttctattatgtttaatagtcgtcctccaatggcagcaactgcagctattatgggggcgatggctaatactttgcgcttaagtttagttgattatgcacatatggcacctgctcttgcagcatttattggtgctttaaccgcggggctgttagcaagtgttgttcgccaaaaagtgggatttcctagaattgccattacagttccatcaattgtaattatggtaccagggctttatatgtatagagctgtctttaatttcggagtcactaatattaatattggtgctttttggattactgaagcattgatgattgttattgctttgccattgggacttttagcggcacgtatattgactgataagaaatggcgtcatgctgat

SEQ ID NO: 290 - protein, 451 aa, Lactobacillus acidophilus
MILPMENEQARRLSQKHHMKILWEDFFKSDDDTIAQDATLVEKTSIVGRIGIMLLSCGTGAWRVRDSMDTVARTLGITCSTDIGLVSIEYTCFDVDNESYSQTLSLPSTGVNMTKLNELEKLIRQFEKERGNWTIGQIHKKLREIENQKSAYPSIIAVLSAGLACAGFIFLLGGGLPKVICAFFGAGVGNYVRSIMGKRKITLVAKIAVAVAIAWAVYFICFHIGMILFHLDYHHAYGYIGAMLFVIPGFPFITSGLDMSKLDMRSGLERLTYAILVIIIATMAGWAVATILNLHPGSMLRLKIDPGMLTFLRLIASFCGVFGFSIMFNSRPPMAATAAIMGAMANTLRLSLVDYAHMAPALAAFIGALTAGLLASVVRQKVGFPRIAITVPSIVIMVPGLYMYRAVFNFGVTNINIGAFWITEALMIVIALPLGLLAARILTDKKWRHAD

SEQ ID NO: 291 - DNA, 1122 bp, Lactobacillus acidophilus
  misc_feature (0)...(0): ORF 1155
  CDS (1)...(1122)
atgaaaaaatatcaactttacgcaacaatgggcgcagggttcgaaagcgtcgtaaataaagaattacaaagtatgggttataaaaccaaggttgaaaatggtcgtgtattttttgaaggtacacaagaagacattgtaaaagtaaatctatggtcaagaacagctgatcgaatcaagattttattaaaggaatttaaggcaacagattttagcactttgtttgatgaagtttatgcttatgattgggcagaattattgccagttgatgcaaaatttccagttcaaggtagagcagtaaaatccaagttgcattcagagcctgatgtacaatctatcgtaaaaaaagcaattgttaataagatgattgatcaatatcatcgccgtggttttttaccagaaactggtaacgaatatccattagatatccatatttacaaaaatttagctagattatcattggatactactggagctagtttatttaagcgtggttatagaattgaacatggtggagctccgatgaaagaaaattttgctgcaagtttattaaagctcactccttataacggcacgcatcccttgatagatccaatgactggatcaggtactttagcaattgaggctgcattgattgccaaaaatattgcacctggtacctggcgcaaatttgcttttgatggcttcgattggtttaataccaatcttcataaagaagcattagctaaagcaaaagcagaggtcaaatctttagaggcacccatttgggctagtgatattgatcaatcagttcttgaaattgctaaacttaatgcacataatgctggagttttacaagatatccgctttaaacaagttgcagtaaaagatttcaccactgatttagaaaatgggattattatagccaatccaccatatggtaaaagactgaaagatcgtgaatctgcggaagaattgtataaacaaatgggagaggctttaagaccgttagattcatttagtcaatattatttaactgcagatcctaattttgaaaaatactttggtgctaaagccacaaagaaacgtaaattatttaatggtaatttaagagttgatttctatcaatattgggctaacagaagg

SEQ ID NO: 292 - protein, 374 aa, Lactobacillus acidophilus
MKKYQLYATMGAGFESVVNKELQSMGYKTKVENGRVFFEGTQEDIVKVNLWSRTADRIKILLKEFKATDFSTLFDEVYAYDWAELLPVDAKFPVQGRAVKSKLHSEPDVQSIVKKAIVNKMIDQYHRRGFLPETGNEYPLDIHIYKNLARLSLDTTGASLFKRGYRIEHGGAPMKENFAASLLKLTPYNGTHPLIDPMTGSGTLAIEAALIAKNIAPGTWRKFAFDGFDWFNTNLHKEALAKAKAEVKSLEAPIWASDIDQSVLEIAKLNAHNAGVLQDIRFKQVAVKDFTTDLENGIIIANPPYGKRLKDRESAEELYKQMGEALRPLDSFSQYYLTADPNFEKYFGAKATKKRKLFNGNLRVDFYQYWANRR

SEQ ID NO: 293 - DNA, 726 bp, Lactobacillus acidophilus
  misc_feature (0)...(0): ORF 1287 -  tRNA (guanine-N1)-methyltransferase
  CDS (1)...(726)
atgaagattaatatcctgaccctttttcctgatatgtttacgccattgcaagtttctatgctgggacgtggtcttgaagatggtaagtgggatctcaatttggttaatttccgtgatttcactacagacctgcatcaccatgttgatgatacgccatatggtggcggagcgggaatggtgcttcaaataatgccgattaagaaagcacttgattcacttccttctactggcaagattattattactgcaccacaaggtaagacatttaatgaaaaaatggcacaagaatgggctaaggaagatgaattaacttttatttgtggtcactacgaagggtttgatcaacgtgtttatgatttggctgatgaaactgtttcaattggagattatgttttaaccggtggagaattacctacaatgagtatggttgatgcaacagttagattattaccaggtattttaggtaattctgcttcatcagttgaagaaagtttctcacatggcttacttgagtatccgcaatatactcgtccagctgatttcgaaggaaaaaaaagtgccagaagttttaagccagtggtaatcatcaaaagattgctgaatggcgacactatcaggcttttaaaggcaacatatttacatagacctgatatgcttgaaaatcgcaatctttctgatgaagaaaagaaaatgctgcaagaaataaagaatgaaatgaatgaggat

SEQ ID NO: 294 - protein, 242 aa, Lactobacillus acidophilus
MKINILTLFPDMFTPLQVSMLGRGLEDGKWDLNLVNFRDFTTDLHHHVDDTPYGGGAGMVLQIMPIKKALDSLPSTGKIIITAPQGKTFNEKMAQEWAKEDELTFICGHYEGFDQRVYDLADETVSIGDYVLTGGELPTMSMVDATVRLLPGILGNSASSVEESFSHGLLEYPQYTRPADFEGKKSARSFKPVVIIKRLLNGDTIRLLKATYLHRPDMLENRNLSDEEKKMLQEIKNEMNED

SEQ ID NO: 295 - DNA, 2001 bp, Lactobacillus acidophilus
  misc_feature (0)...(0): ORF 1543 - theronyl-tRNA synthetase (EC 6.1.1.3)
  CDS (1)...(2001)
ttgggtggaaccacgcaattaacgtcccagtgcattgtcgcactgggatttttttttggaggtaattttatgagtttttcagttactttgccagatggctcaaagaaagaattcgacaaggctgtttcagttaaagaagtagcttcatcaatcgctacttctcttggaaaggctgctgttggtgctaaggtaaatggtcaagttaagccacttgattacgaaattgatagtgatgttgaaattgctatcattactgataaggatgaagaaggattagatatcttaagagcaactgcagcttttgcatttgaagctgttgctaagaagaagtacccagaacttcgtttaggtcaacacgtagctgatgaaggtggcttctatgttgatactgacaagaaggaccaaattaaggttactgaattgccagaacttgaaaaggcaatggaaaagcttattaagagtggtcaacctattgaacatgttgtaatggacaagtcagaacttgaagaaatgttcaaggatgatccattcaagagcgatcttttaaagaagattgactctgacaaggttgatgcttacaaattaggtgactttgtggactttggctttgatgcattattaccaaacactggtaaaattaagcactttaagcttttatcagtagctggtgcttactggcttggtaagtcatcaaaccctatgcttcaaagaatttttggtactgcattcttcaaggaagctgctttaaaggaagacttgaagcgtcgtgctgaaattaaggaacgtgaccaccgtactatcggtcgtgaccttgatctcttcttcgtagatcctaaggttggtgcaggtcttccttactggatgccaaagggtgctactattcgtcgtgttgttgaacgttacatcatcgatcgtgaagtagctgacggttacaagcacgtttacactccagtacttatgaaccttgatgcttacaagacgtcaggtcactgggcacactatcgtgatgacatgttcccaccaatggacatgggtgatggcgaaatgcttgaacttcgtccaatgaactgcccatcacatattcaaatttacaagcaccacattcgttcataccgtgatttaccacttcgtgttgctgaacttggtatgatgcacagatacgaaaaatcaggtgctttatctggtcttcaacgtgtacgtgaaatgaccttgaacgatggtcacacatttgtagaacttgatcaagttcaaagcgaatttgctaagatcttgaagttgatcatggacgtatacagagacttcgatattactgattactacttcagactttcataccgtgatccaaagaacactgacaagtactttgcaaatgatgaaatgtgggaaagaagtcaaaagatgcttaagggtgctatggatgaccttggccttgactatgttgaagctgaaggtgaagcagcattctatggtcctaagcttgatattcaaactaagactgctttgggtaacgacgaaactatgtcaactatccaacttgatttcatgctcccagaaagatttggcttaacttacgttggtaaagatggtgaagaacaccgtccagttatggttcaccgtggtattgttggtactatggaaagattcattgcttaccttactgaaatctacaaaggtgcattcccaacttggcttgctccagttcaagctgaaatcatcccagttaacaatgaagctcatggcgaatatgcagaaaaggttcgtcaagaacttgctaagcgcggcttcagagtagaagttgatgatagaaacgaaaagatgggttacaagattcgtgaatcacaaactcaaaaagtaccttacactttagtattaggtgacgaagaaatgaagaacggtagcgttaacgtacgtcgttacggtactgatgaagaaatttctaagagtcttgatgacttcattaatgaaattgatgctgacgttaagtcatactcaagagaaaac

SEQ ID NO: 296 - protein, 667 aa, Lactobacillus acidophilus
MGGTTQLTSQCIVALGFFFGGNFMSFSVTLPDGSKKEFDKAVSVKEVASSIATSLGKAAVGAKVNGQVKPLDYEIDSDVEIAIITDKDEEGLDILRATAAFAFEAVAKKKYPELRLGQHVADEGGFYVDTDKKDQIKVTELPELEKAMEKLIKSGQPIEHVVMDKSELEEMFKDDPFKSDLLKKIDSDKVDAYKLGDFVDFGFDALLPNTGKIKHFKLLSVAGAYWLGKSSNPMLQRIFGTAFFKEAALKEDLKRRAEIKERDHRTIGRDLDLFFVDPKVGAGLPYWMPKGATIRRVVERYIIDREVADGYKHVYTPVLMNLDAYKTSGHWAHYRDDMFPPMDMGDGEMLELRPMNCPSHIQIYKHHIRSYRDLPLRVAELGMMHRYEKSGALSGLQRVREMTLNDGHTFVELDQVQSEFAKILKLIMDVYRDFDITDYYFRLSYRDPKNTDKYFANDEMWERSQKMLKGAMDDLGLDYVEAEGEAAFYGPKLDIQTKTALGNDETMSTIQLDFMLPERFGLTYVGKDGEEHRPVMVHRGIVGTMERFIAYLTEIYKGAFPTWLAPVQAEIIPVNNEAHGEYAEKVRQELAKRGFRVEVDDRNEKMGYKIRESQTQKVPYTLVLGDEEMKNGSVNVRRYGTDEEISKSLDDFINEIDADVKSYSREN

SEQ ID NO: 297 - DNA, 2118 bp, Lactobacillus acidophilus
  misc_feature (0)...(0): ORF 1654 - surface protein
  CDS (1)...(2118)
gtgtcatataatgtatacaaggaaggaaaaggatatattattatgtactacggaggtactaaaatggttaagacaaagaagacgcaatttgctattcgcaaattggctaagggtgctgttgcagtgttattaagtttcggcatactagctggtcctagtgcgccaattgtctcagcagcctctgaagcaattcaaaatgaaatgacagatgatacaacttcagtagtagaagaaagtgtccctgtagaaaataatacagcagacactttaactactgataatactggagtttcagctaattactctgaaaatactgatgatagtactacaactactgtgcaaactgatacagatgtatctactcaagaaaaaacagatccagtaacatctgttaatactgagcaaccagttcaaacagaagaagctgaaagtactactccagttgaagatgtaaattcaaaatctgaagaaaatgtatctcaaaataataatattaatacttctaccgaagatacaaattcgactaatactgaagcagaagtgaacaaaaatactacttctaaagaagatacaaataaaaaagataaaccaaatattaatgaaatgaccaaggaagaattggcaaatcatattaaagatttggcaaataaacatcctttaggtatcgctggtatcttccatattttcggtaatgaagtgactcaaaatggtcgtattgcaggtaatattgctacagataaactttctggtacaaattttggtaccaattcaaatgcaaccaataatttaaccaacggtgatatccactatgttggcaatctcaatggacttaacaaaatcgacggtgacaacaaagtagtcatctttggaccagacattgaataccgttcatttgagaatgatggagcaattgaagttaactatggaactgctgaaaaacctgactggagaaaagtagatattccttataaccacattgttcaagctgatcaaaaaattaatattcaaggcgaactagataaattaagtcaaaagtcagataactgggctagtcaagcacagactgaaggagttaaagccgattttagtactgacaatagttggatcgatgtttctgaagctataaagaatgctggcgacaataaggaacctatttacgtaacaattgatgccgcacacctttcaggcgacaaacgtaatattacgatcaaaggtattcctgctggtgctgaagctccaatgattattttaaatgtaactaatattcaaggtggagatttaacagttcaaactcacctcgtactggaatatgctgatggtaataatattggtggttcttctgaaactccaactcaatttaataaattgctctggaacttcggtacagatgttaataaattacattttgctagagactaccatttgggaagtgttctagcaaccaacgctcatattacaaatgctgttaatattgacggtaatattattggtaacaaagttactgttagtggtgaaacacaccgttgggacttaacaccgccattcgtagaaattgaagaacctgaaaagcctaagcctgagcctaaaccagatcccgaaccgaagccgaagcctaagcctgaccctgagccagagccagagcctgaaaatccaactccagatactcctgctccacaacctaaaccagaggaaactcctgacaatacagaagattttactcctccattaactgtagatgtactggatccagatggtacagatgaaaatgaaacaccagctggagaagaatcaacagaagaagaagctattgctccacttcctgaaaatgtaatcgaaaaaaatcaaaaagaagtaacttcttccaagtctacggtaactcctactcctgtaaccgagaaatctggtgaaacaacaactaaaccgaaagcagaagtaaaaaatgaaactgtaactgcaactgaaaccacaaaagaagttggacttccagaaaccggtgaagataaaactaacctcattactataggcatttgttttagcaagtattgctgcaacaatcacggcattaggctcattcatcaacaagaaaaagaaaaattaactaaaaataagcatctaaaa

SEQ ID NO: 298 - protein, 706 aa, Lactobacillus acidophilus
MSYNVYKEGKGYIIMYYGGTKMVKTKKTQFAIRKLAKGAVAVLLSFGILAGPSAPIVSAASEAIQNEMTDDTTSVVEESVPVENNTADTLTTDNTGVSANYSENTDDSTTTTVQTDTDVSTQEKTDPVTSVNTEQPVQTEEAESTTPVEDVNSKSEENVSQNNNINTSTEDTNSTNTEAEVNKNTTSKEDTNKKDKPNINEMTKEELANHIKDLANKHPLGIAGIFHIFGNEVTQNGRIAGNIATDKLSGTNFGTNSNATNNLTNGDIHYVGNLNGLNKIDGDNKVVIFGPDIEYRSFENDGAIEVNYGTAEKPDWRKVDIPYNHIVQADQKINIQGELDKLSQKSDNWASQAQTEGVKADFSTDNSWIDVSEAIKNAGDNKEPIYVTIDAAHLSGDKRNITIKGIPAGAEAPMIILNVTNIQGGDLTVQTHLVLEYADGNNIGGSSETPTQFNKLLWNFGTDVNKLHFARDYHLGSVLATNAHITNAVNIDGNIIGNKVTVSGETHRWDLTPPFVEIEEPEKPKPEPKPDPEPKPKPKPDPEPEPEPENPTPDTPAPQPKPEETPDNTEDFTPPLTVDVLDPDGTDENETPAGEESTEEEAIAPLPENVIEKNQKEVTSSKSTVTPTPVTEKSGETTTKPKAEVKNETVTATETTKEVGLPETGEDKTNLITIGICFSKYCCNNHGIRLIHQQEKEKLTKNKHLK

SEQ ID NO: 299 - DNA, 1314 bp, Lactobacillus acidophilus
  misc_feature (0)...(0): ORF 1793 - transport accessory protein
  CDS (1)...(1314)
atgaataagaaaaatgtatcaatgctaatgttaagtccagcaatcttattaatgatgaatagtactattgtgcatgcggataaaggtagtacttctcatgagattagtagtaaagtagtatctaaaacaaaaaatgatgataaaaatgttcctgaatccgagcaagaaactagtagtaataacgaaattgatcaatctcaagataagcaggaaaaagaagaacaagcaattcctgaagatcaaaatgatcaatctcagaatacaaataatcaagatcctaatgacgcaagtgaagaagatgatgaagatgaagtatctgttgaagattatgaaaacaatgtaaaagattttcatagagtgaaaatgcaagaggtgaaagatcttctagcagagaaaaataatcaagaacatcttatgtacattggtcgcccaacatgttattactgccgacaattttcacctgatttaaaagatttcaatgaaatcgttaaaggtaagctgctttatttcaatattgatgatgaagaaggagcacatgattatgcttttaaggttattggtattccaggaacacctacaacgatgagatttatgaatggaaaattgataagtgcttggataggtggagaaaaaacaggacaagagctacatgattttttgtattctgacacagctaataaattagtagaacaggttgtaattaaaaatcaatcgaatgatacggctactcaagcagataatgatgtcgttgcatctgagagcgataaaacacctgaagtgactgtagaggaaaataatcaagcgcagtctaataatgatgtcgctattactaacttcgctgagaatagtgtatttgaaaatgctaaaaatgttgctagttctactgcggatttaactcaagtagcgacgggcgatcaagatgatgtagctcctaaagctgaaactaaaaataaaactgtgaagaaaccaataaaacataaaattgtagccaataaggttaagaaacaagctaaattgcataagacgaatattattatacctatgtccgctaaaaaacgtgaagatgtaaaagaaaataatcaatatgatacggtaaaagtacacggtacatctcctaatgcaattaaggacaaacaagctagaattactatgttgaaggaacttgagaatgatacttcagatactatttctactgtgtctttgccgtctactggtgagaagaaaaatatctggattcaattaatgggaatgattagtgttctagttagtgtagttttaggtatttcgttaagaaagaaaactaaggaggaaaag

SEQ ID NO: 300 - protein, 438 aa, Lactobacillus acidophilus
MNKKNVSMLMLSPAILLMMNSTIVHADKGSTSHEISSKVVSKTKNDDKNVPESEQETSSNNEIDQSQDKQEKEEQAIPEDQNDQSQNTNNQDPNDASEEDDEDEVSVEDYENNVKDFHRVKMQEVKDLLAEKNNQEHLMYIGRPTCYYCRQFSPDLKDFNEIVKGKLLYFNIDDEEGAHDYAFKVIGIPGTPTTMRFMNGKLISAWIGGEKTGQELHDFLYSDTANKLVEQVVIKNQSNDTATQADNDVVASESDKTPEVTVEENNQAQSNNDVAITNFAENSVFENAKNVASSTADLTQVATGDQDDVAPKAETKNKTVKKPIKHKIVANKVKKQAKLHKTNIIIPMSAKKREDVKENNQYDTVKVHGTSPNAIKDKQARITMLKELENDTSDTISTVSLPSTGEKKNIWIQLMGMISVLVSVVLGISLRKKTKEEK

SEQ ID NO: 301 - DNA, 1116 bp, Lactobacillus acidophilus
  CDS (1)...(1116)
  misc_feature (0)...(0): ORF 1080: MetK - methionine synthase II
atgagtaaaactttagtacattatgacattgttggtagtttcttaagaccagaagaattgaaaaaggcacgtgctgattttgcagcgggtaacatttcaaaaactgacttgaaaaaggttgaagatgaagaaatcgctaaattagttaaaaaagaagaaaaagctggtttaaagattgtaactgatggtgaattcagaagaagttattggcaccttgatactttttggggcttcggtggaattaagcacactactcaagaacatggctacttcttccacgatgaagaaactcgtaatgattctgctcaagttgagggaaagattaaatttacaggtgatcatccagatttagaagcatttaagtttttgaagagtttaaccgatggcagtgatgtaactccacgtcaaagcattccttcaccagcccaattttacgcagaactcgtccgtggcccagaaaatgttgcagcagtgaagaaagtttacgataccgaagacgaacttttaaacgatatttcaaaagcatattatgatttaatcatcgcactttacaaagcaggttgtcgcgatgtgaaattggatgactgtacttggggaatggtcgtagatgatgatttctgggcaacaatggttaaacaaggttttgaccgtgacgaacttcaagaaaaataccttcgtgttaacaatggcgcacttaaagatctaccagctgatttaagaacttcaactcatatttgtcgaggcaattaccactcaacttgggctgctaaaggtggttatggaccggttgccaaatacgtttttgcacaagaaaatgtcgatgcattctatcttgaatttgataatgaaagatcaggtaacttcgatccaatcaaggaaattcctgctgataaagaagtagtacttggtttagtaactagtaagaaacctgaattggaaaagccagaggatttgattgctcgtatcaatgaagcaagtaagttccacgatttagccaacttagccttaagcactcaatgtggttttgcatcaaccgaggaaggaaaccaattgacagaagacgatgaatggaaaaagattggcttagtaatcgatactgctaagcaagtttggaag

SEQ ID NO: 302 - protein, 372 aa, Lactobacillus acidophilus
MSKTLVHYDIVGSFLRPEELKKARADFAAGNISKTDLKKVEDEEIAKLVKKEEKAGLKIVTDGEFRRSYWHLDTFWGFGGIKHTTQEHGYFFHDEETRNDSAQVEGKIKFTGDHPDLEAFKFLKSLTDGSDVTPRQSIPSPAQFYAELVRGPENVAAVKKVYDTEDELLNDISKAYYDLIIALYKAGCRDVKLDDCTWGMVVDDDFWATMVKQGFDRDELQEKYLRVNNGALKDLPADLRTSTHICRGNYHSTWAAKGGYGPVAKYVFAQENVDAFYLEFDNERSGNFDPIKEIPADKEVVLGLVTSKKPELEKPEDLIARINEASKFHDLANLALSTQCGFASTEEGNQLTEDDEWKKIGLVIDTAKQVWK

SEQ ID NO: 303 - DNA, 471 bp, Lactobacillus acidophilus
  CDS (1)...(471)
  misc_feature (0)...(0): ORF 1081: LuxS - Autoinducer AII
atggcaaaagttgaaagttttacattagaccacactaaagttaaggcaccttacgttcgtttaattactgttgaagaaggtcctaaaggcgacaagatttctaactatgacttacgtttagttcaaccgaacgaaaatgcaattcctaccggcggattgcatactattgaacacttacttgccagcttacttcgtgaccgtcttgatggtgtaatcgattgttcaccatttggttgccgaacaggattccacctaatcgtttggggtgaacattcaactactgaagttgctaaagcattgaagtcttcattagaggaaattcgtgacacaattacttgggaagatgtaccaggtacaactattaagacttgtggtaactaccgtgatcactcattgttcaccgcaaaagaatggtgtcgtgatattcttgaaaaaggaattagtgatgacccattcgaaagaaatgtgatt

SEQ ID NO: 304 - protein, 157 aa, Lactobacillus acidophilus
MAKVESFTLDHTKVKAPYVRLITVEEGPKGDKISNYDLRLVQPNENAIPTGGLHTIEHLLASLLRDRLDGVIDCSPFGCRTGFHLIVWGEHSTTEVAKALKSSLEEIRDTITWEDVPGTTIKTCGNYRDHSLFTAKEWCRDILEKGISDDPFERNVI

SEQ ID NO: 305 - DNA, 1797 bp, Lactobacillus acidophilus
  CDS (1)...(1797)
  misc_feature (0)...(0): ORF - 223
atgtcttttcgattaagaaaagatgtctttttttgtcctaaaattggcaaatttccaatttggatttacaatagagtagatgagtttaaatatagcatgcgaggtatattatcgatgaaattaaatcataagttgattatggtatcagcagctgcattaatgagcgtaagtccatttgtaggtactgtgcaaaatgttcaagctgctactactaaatcatcaagcaaaactactgctaagaagactacttcagcttcaaagactaagactaagtcttcatcaaagaaggctactagtcaatctacttcaactaagaagacaagttcaacaaaatcaagctctaagactacttcttcaactagtgcaaagagtacttcaactaagaaggcagcttcaaacactattaagttagttcacaatgcttatgtttatgacaagaatggtaagcgtcttactaagtacatgggcagtgcaaagtacactactattgctaaaggtgtaactcttaagtctaatggtacagtgaagatcgatggtgttctttactacagcctcggtaataatgcctatattaaggctgttaacgtagatggcccatctgcttcagcttcatcaactactaagaagccatcttcaagtacttcttcaacagtaactgctgtaagcattaagattgctcgtaattcatacgtttatgatgaaaatggtaagcgtattaaaaagtatgaaggtaaagataaacttactaagggtactactgttgattcatacggtacagaaactattgatggtaagttatactaccaacttaataaaaagggtacagcttttgtaaaggcaagtaatgtagatacaaatgaaacagctactattactttaaagaagaatgcctacatttatgatggcaatggcgatactaagaaaaagaaaattaagaagggcaagagtgtaaaggctactgaagcaagatacattggtactaagctttactacaagattggtgatgatcaatttgtaaaggctgctaatgtgggtaaagtttcaggtgctaagcttgatcctatcaatgaaccagatggagaagcaactgttgatgatccatcgactgataatgttaacccagatgtaactaaggtaactaccattggtgtaactccactttacaatattaagggtcaaaaagacgacaccagattatttggtgctggtcaaagtcaacaagtttcagaattaagatatattgcaacttcagcaaacggtaccccagacttgttctacaaattagctagtggtagaggttacttgaaggctagtgatgtaattgttagtggtaagactttgtcacctgttaatactccagaacaagctaaggctgatgtaactgttgcaactgcagcagataagactaagttgtcagaaagtattaataattctaagaacgttaaaaattctactacttacaagctttcatcatcagacttaagaaataactatgataaggctgtttctgatgcaactgctgttaataacaatgcttcagcaactattgctcaagttaatgaagcagtagctaacattaatgaagcttacgctaagcttaacggtcaaaaaatagttgtagctaacttaagtaatcttactttagatgaagccaaccaaattgttaagttagttgctagtgtaagaaacgttccagaaagtaatgttcaattctcaaataacaacactactttagcaatcgtttcatcaaatggctacaatgaacctttgaatattagcgactttgctcaacaaaga

SEQ ID NO: 306 - protein, 599 aa, Lactobacillus acidophilus
MSFRLRKDVFFCPKIGKFPIWIYNRVDEFKYSMRGILSMKLNHKLIMVSAAALMSVSPFVGTVQNVQAATTKSSSKTTAKKTTSASKTKTKSSSKKATSQSTSTKKTSSTKSSSKTTSSTSAKSTSTKKAASNTIKLVHNAYVYDKNGKRLTKYMGSAKYTTIAKGVTLKSNGTVKIDGVLYYSLGNNAYIKAVNVDGPSASASSTTKKPSSSTSSTVTAVSIKIARNSYVYDENGKRIKKYEGKDKLTKGTTVDSYGTETIDGKLYYQLNKKGTAFVKASNVDTNETATITLKKNAYIYDGNGDTKKKKIKKGKSVKATEARYIGTKLYYKIGDDQFVKAANVGKVSGAKLDPINEPDGEATVDDPSTDNVNPDVTKVTTIGVTPLYNIKGQKDDTRLFGAGQSQQVSELRYIATSANGTPDLFYKLASGRGYLKASDVIVSGKTLSPVNTPEQAKADVTVATAADKTKLSESINNSKNVKNSTTYKLSSSDLRNNYDKAVSDATAVNNNASATIAQVNEAVANINEAYAKLNGQKIVVANLSNLTLDEANQIVKLVASVRNVPESNVQFSNNNTTLAIVSSNGYNEPLNISDFAQQR

SEQ ID NO: 307 - DNA, 3859 bp, Lactobacillus acidophilus
atgaaattagcctatgacgattggcgtaaaaataaagaaaagaattatccttttgcgggttacactgtagagattgattcattatcgaatgctccattaacaaatggaggtacctacactatcaatttgggaaccgaaactcgcctttataatgaaccatattgggtaataacttcacgcactattcattatgtaaaatatggtctaaccggttctgatagtgttgcttctccagatgtgatccaggaaggtcattcaaatgtaaccagttctaaaaataatccagtggtaaataactttaatttagaaaaagatggtcatcactatgtgagttatgaaacggttcaaagatcgtataatgtagcttctggtattcctgatgggatgacagataataaaggtaatatgaattctattattatctttgatggacagataaacccaactattactgattgggttactccagatcctgatgtaactcaaaccaaatcaccgggcaagaatctttctaataaaattccaacaaatggtgaatcttacaattacctctatagaaagttctatcatcataactattatgataaagatggtaacttccatcagaagacatatcttcctaataatgaaggagagccaattactattacttactaccacaaccaacctgtagatctttcatttgaagatatttcaaagattgatcctcaagatttaagtgggagcaactattctgctactaacgaattaacgacaaagaacgatgatagtaatcaatacaatgtttacgatgcatcaaatggtactaaaagtttaagtcaagtaattagtgatattgaagcgaaaggttacaagcttgtttcaattactaacgatgacgatgattctcaaaccgacttgaagggcaacagttcaattgatttaatctataacaaagatggtgtttggaagagtgcaactggtggggataatgctgataacttgattcataagcgctacactatcaagtttgttcatgacgtaaaacctacaactaaaaatacttctgtaagccgtaacattcactatgtggctgacgaaggcaatagcaagtatgaagtattgaagaatcctgatactcaaactgttaactttgaacgtactgcttatattgatcaagttactaagcaagaagttattaagaatgcagatggtacttacagtgaattaccagctgacttcaagccaacttggaaagctgttggaactgataactttgataaaatccaaaaggatagatttaacaaggatgaaggtaaggttcctggcgtttgggaaattgaacgtgctaactatgatgatccagagggaactcaattaacggataactttgctcctaaagttgcaaatgttgatgctgctaagacttataatgatatttatcttgtttacaaacaaaaagctcaatataatattcactacattgatgttaatggtgtagaagataaaaacacttatactccaactgacggttatgaacttaccgatcatttagttcctaacgttggtgaaggtaaaggtatctttattggcgacactccagatgctacgcagaagttatggagcccagcagactacgaaaaggctggatatgttttagttggtttatctgataatgccaaaggcgatttactcggtaagcaaaccttaactaaggacgttcaagatcaatacgtttacttgaagcatgcaatcaccccttcaactgataagacacctaaagaagacgtgaaggccgaaactgtcagtcaagtacgtactatttcatatcgggatgctgaaactggtgaaaagattacagatgaattaaagaagtacggtattactgctaatgttcctgacattacgcaaactatcgattatgttcgtgtgcctctttatgatgcatttaagggtatgtttttaggctttgcagcaattcaaactgatgcaaaaggttttgctaagcttgatagtaacggtaaaccagagatcaagaaagatactaatggccaaccaattattgctactcgagatgataaggcatcatgggttccaactggtgaacatactgactatccagaacaaggctcacctgatttaactaagtatgggtatgtaaaggaaagctcattagaacaaaagactaataacaaggatggcgcacaggtagatgctaaagacggtgacccaactcaatccggtggccacgtggatgtttactacttccacgaacaagaagatatcacttatgtgaatccgaagtttaatattgaccaaaaggatcttgaaaagacctttaaaagaacgattatctaccgtggtaccaaagacggtcatacttatgaagatgtaaatggttcaccagatggcactcataagtatgttcagactaccacctttactcgtaaggcgattgtagatgcagtaacgaaaaaagtgattaaatatactccttggacatcaactaaaacaactttagtagaagttatttctaagacacctactgaagtgggttatgacaatgttgatattaaatcagtttctgcacgtactgttgatccagataaggatccagaagatttaggtacaacagttgtaacttatactgtcaacccaactccaacacctgaaccaaatccaggtaatggcggtaacaccagcgatggtggaaatactcctgatggaggctcagaacaaccaaataatcctggtaacaacaatgaagttccaggtaacccgggcggtgacaatgaaacacctaaggaaactccaactcctaaggatgataagactacaccagaaaaaccagatgaacatgacgatttgaaattgaagtcacctgacgaacataaccatactccaaagaaggaagttaacaagacttcaaataatactccacgtagcgaacgctggaactcaaacaaatctcctaaatcagaaaacgtaaataatgtaacaggttctaattccgcagttaaatctaccaatagtcctgaaacagtaaaggaaaatactttaccgcagactggttactaggatcagtgatactgtcttcagtatttccacttaaataatctcccgaatctttaggcgttgatactaatggggaaacttcatactttgaattatctgtagttattaaaccttgaatgtatttacctacatcttgaagagtatcatcatttttacctttataagtaatgcttggaagattttctgtctctccgttttcattagtccagtttaaattaatagtagctgaaaggtcatcttgcgctttactttcagttaaagctttagctgaaagtggagttgtactagctaatttgagagcttgagtttgaatctcttgagtttcaatccccttcttatcagaagttaaatctttgtgagactcagatttaacttctactggatttgccttttcaactttagattcactagtcttatttgcttcactcttgttttctaaggaagtcttttgttcttctttattatctgttgcggtagaaccaacagattggtccttcttttctaatgattcagtcttcttattattaatttcttgagttgaggtagttctaccttccgtagaactctttgcttctgcaggagcttgaggtgtatggctaacttctacatgagaagagacttacataatttagacgtaggggacgttaaagaaaaacaacgtttttcaattcgcaagttaactgtaggtactgctagtgtattgctgggtactacattcttgtttggtgcaggtcagactgcttacgctgatactactgcttcaggtgctattactagtgaagattcccaaaaccaaattgggggg

SEQ ID NO: 308 - protein, 5 aa, Artificial Sequence
  Motif
  MISC_FEATURE (3)...(3): Xaa = Any Amino Acid
LPXTG

That which is claimed:

1. An isolated nucleic acid molecule comprising a nucleotide sequence
    that encodes a polypeptide comprising an amino acid sequence having at least 80% sequence identity to the amino acid sequence of SEQ ID NO: 58 wherein said polypeptide increases the fibronectin-binding properties of a cell expressing said polypeptide;
    or a full-length complement thereof.

2. A vector comprising the nucleic acid molecule of claim 1.

3. The vector of claim 2, further comprising a nucleic acid molecule encoding a heterologous polypeptide.

4. A host cell that contains the vector of claim 2.

5. The host cell of claim 4 that is a bacterial host cell.

6. A method for producing a polypeptide comprising culturing the host cell comprising a vector comprising a nucleic acid molecule under conditions in which the nucleic acid molecule encoding the polypeptide is expressed, said polypeptide
    comprises an amino acid sequence having at least 80% sequence identity to the amino acid sequence of SEQ ID NO 58 wherein said polypeptide increases the fibronectin-binding properties of a cell expressing said polypeptide.

7. The isolated nucleic acid molecule of claim 1, wherein said nucleic acid molecule comprises the nucleotide sequence of SEQ ID NO: 57.

8. The isolated nucleic acid molecule of claim 1, wherein said nucleic acid molecule comprises a nucleotide sequence having at least 80% sequence identity to SEQ ID NO: 57.

9. The isolated nucleic acid molecule of claim 1, wherein said nucleic acid molecule comprises a nucleotide sequence having at least 90% sequence identity to SEQ ID NO: 57.

10. The isolated nucleic acid molecule of claim 1, wherein said nucleic acid molecule comprises a nucleotide sequence having at least 95% sequence identity to SEQ ID NO: 57.

11. The isolated nucleic acid molecule of claim 1, wherein said nucleic acid molecule encodes a polypeptide comprising the amino acid sequence of SEQ ID NO: 58.

12. A vector comprising the nucleic acid molecule of claim 7.

13. A host cell that contains the vector of claim 12.

14. A vector comprising the nucleic acid molecule of claim 8.

15. A host cell that contains the vector of claim 14.

16. A vector comprising the nucleic acid molecule of claim 9.

17. A host cell that contains the vector of claim 16.

18. A vector comprising the nucleic acid molecule of claim 10.

19. A host cell that contains the vector of claim 18.

20. A vector comprising the nucleic acid molecule of claim 11.

21. A host cell that contains the vector of claim 20.

22. The method of claim 6, wherein said nucleic acid molecule comprises at least 80% sequence identity to the nucleotide sequence of SEQ ID NO: 57.

23. The method of claim 6, wherein said nucleic acid molecule comprises at least 90% sequence identity to SEQ ID NO: 57.

24. The method of claim 6, wherein said nucleic acid molecule comprises at least 95% sequence identity to SEQ ID NO: 57.

25. The method of claim 6, wherein said nucleic acid molecule comprises SEQ ID NO: 57.

* * * * *